(12) United States Patent
Giege et al.

(10) Patent No.: US 10,781,457 B2
(45) Date of Patent: Sep. 22, 2020

(54) METHOD FOR INCREASING THE RESISTANCE OF A PLANT TO A PLANT RNA VIRUS

(71) Applicant: CENTRE NATIONAL DE LA RECHERCHE SCIENTIFIQUE, Paris (FR)

(72) Inventors: Philippe Giege, Strasbourg (FR); Anthony Gobert, Schiltigheim (FR)

(73) Assignee: CENTRE NATIONAL DE LA RECHERCHE SCIENTIFIQUE, Paris (FR)

( * ) Notice: Subject to any disclaimer, the term of this patent is extended or adjusted under 35 U.S.C. 154(b) by 0 days.

(21) Appl. No.: 15/313,058

(22) PCT Filed: May 22, 2015

(86) PCT No.: PCT/IB2015/053796
§ 371 (c)(1),
(2) Date: Nov. 21, 2016

(87) PCT Pub. No.: WO2015/177772
PCT Pub. Date: Nov. 26, 2015

(65) Prior Publication Data
US 2017/0096678 A1 Apr. 6, 2017

(30) Foreign Application Priority Data
May 23, 2014 (EP) .................................. 14305771

(51) Int. Cl.
*C12N 15/82* (2006.01)
*A01H 4/00* (2006.01)
*C12N 9/22* (2006.01)
*C12N 15/52* (2006.01)

(52) U.S. Cl.
CPC ......... *C12N 15/8283* (2013.01); *A01H 4/008* (2013.01); *C12N 9/22* (2013.01); *C12N 15/52* (2013.01); *C12Y 301/26005* (2013.01)

(58) Field of Classification Search
CPC .................................................. C12N 15/8283
USPC ......................................................... 800/279
See application file for complete search history.

(56) References Cited

PUBLICATIONS

Anthony et al. 2010, Nature Structure & Molecular Biology 17:740-744.*
Dreher, T.W., "Role of tRNA-Like Structures in Controlling Plant Virus Replication," Virus Research 139(2):217-229, Feb. 2009. (Author Manuscript provided, PMCID:PMC2676847, available in PMC Feb. 1, 2010, 29 pages).
Gobert, A., et al., "A Single *Arabidopsis* Organellar Protein Has RNase P Activity," Nature Structural & Molecular Biology 17(6):740-744 (with "Online Methods"—2 pages; and Supplementary Text and Figures—11 pages), Jun. 2010.
Gobert, A., et al., "Structural Insights Into Protein-Only RNase P Complexed With tRNA," Nature Communications 4(1353):1-8, Jan. 2013.
Gutmann, B., et al., "PRORP Proteins Support RNase P Activity in Both Organelles and the Nucleus in *Arabidopsis*," Genes & Development 26(10):1022-1027, May 2012.
International Search Report dated Aug. 20, 2015, issued in corresponding International Application No. PCT/IB2015/053796, filed May 22, 2015, 4 pages.
Matsuda, D., and T.W. Dreher, "The tRNA-Like Structure of Turnip Yellow Mosaic Virus RNA Is a 3'-Translational Enhancer," Virology 321(1):36-46, Mar. 2004.
Written Opinion dated Aug. 20, 2015, issued in corresponding International Application No. PCT/IB2015/053796, filed May 22, 2015, 6 pages.

* cited by examiner

*Primary Examiner* — Li Zheng
(74) *Attorney, Agent, or Firm* — Christensen O'Connor Johnson Kindness PLLC

(57) ABSTRACT

The disclosure relates to a method for increasing the resistance of a plant to a plant RNA virus, comprising expressing in said plant a mutant protein-only RNase P enzyme lacking a nuclear localization signal domain or an organelle targeting sequence domain, and related compositions.

Figure 1:
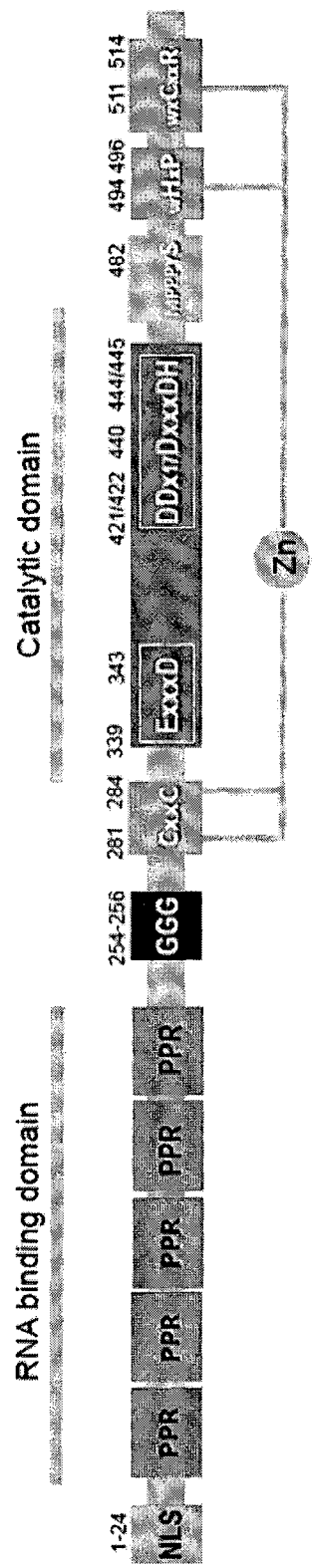
Figure 2A:
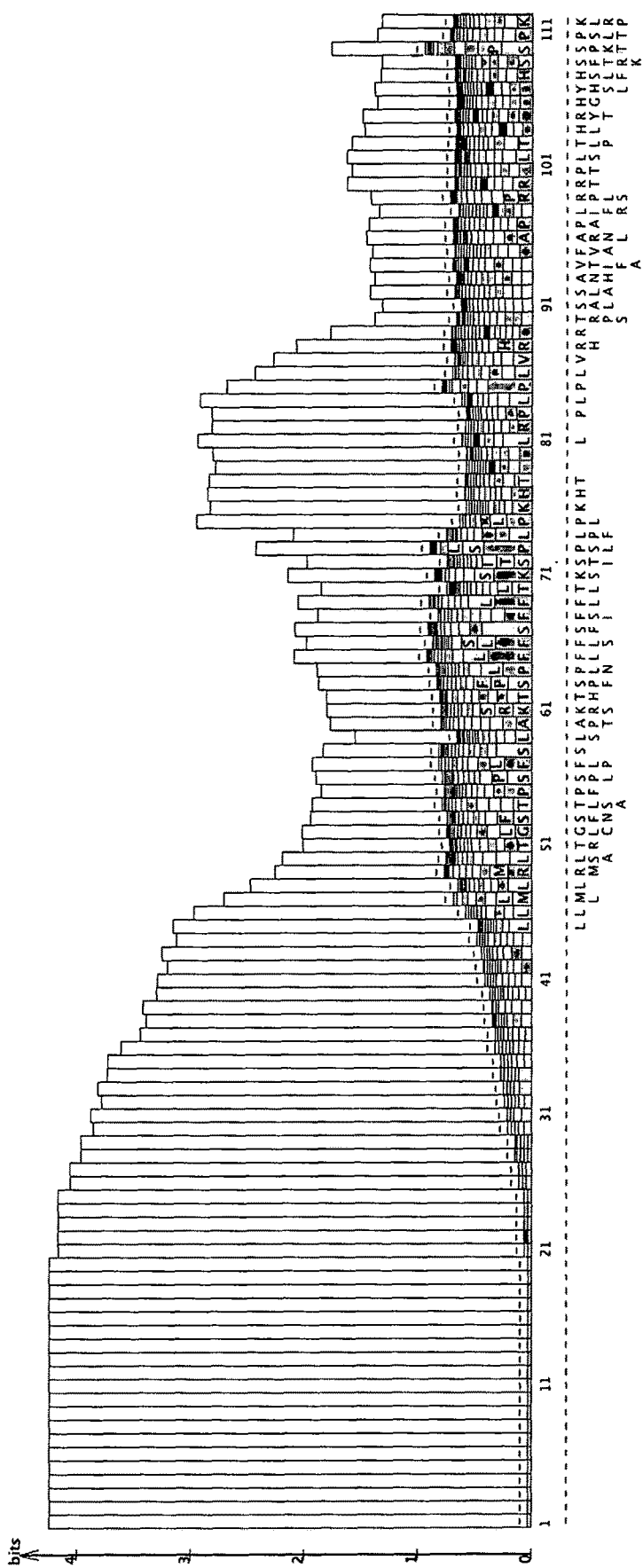
Figure 2B:
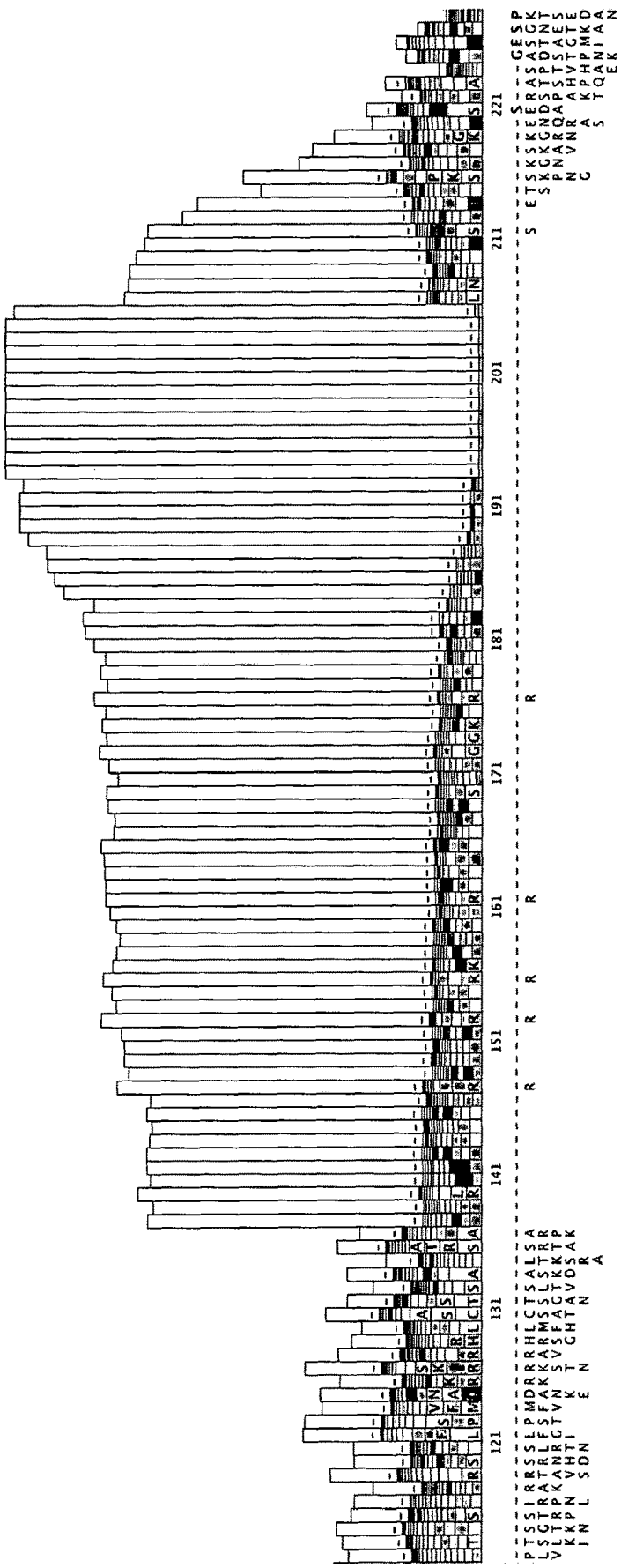
Figure 2C:
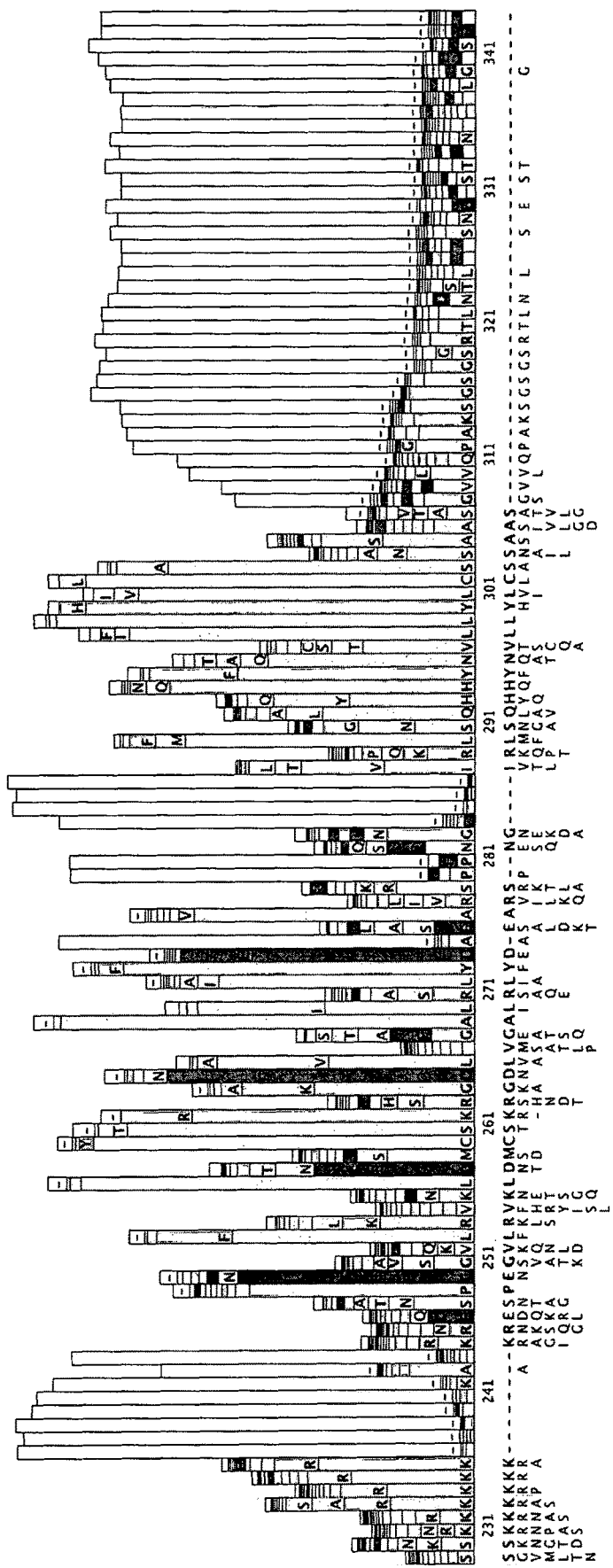
Figure 2D:
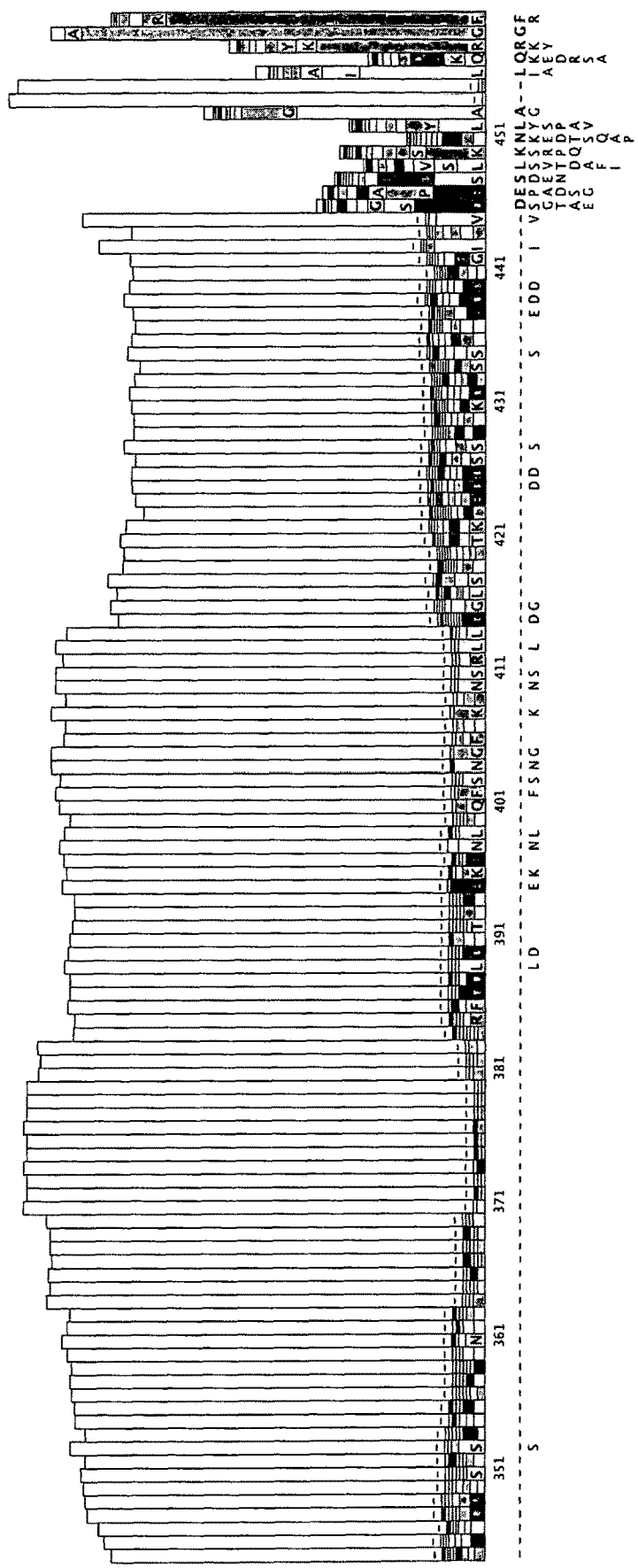
Figure 2E:
Figure 2G:
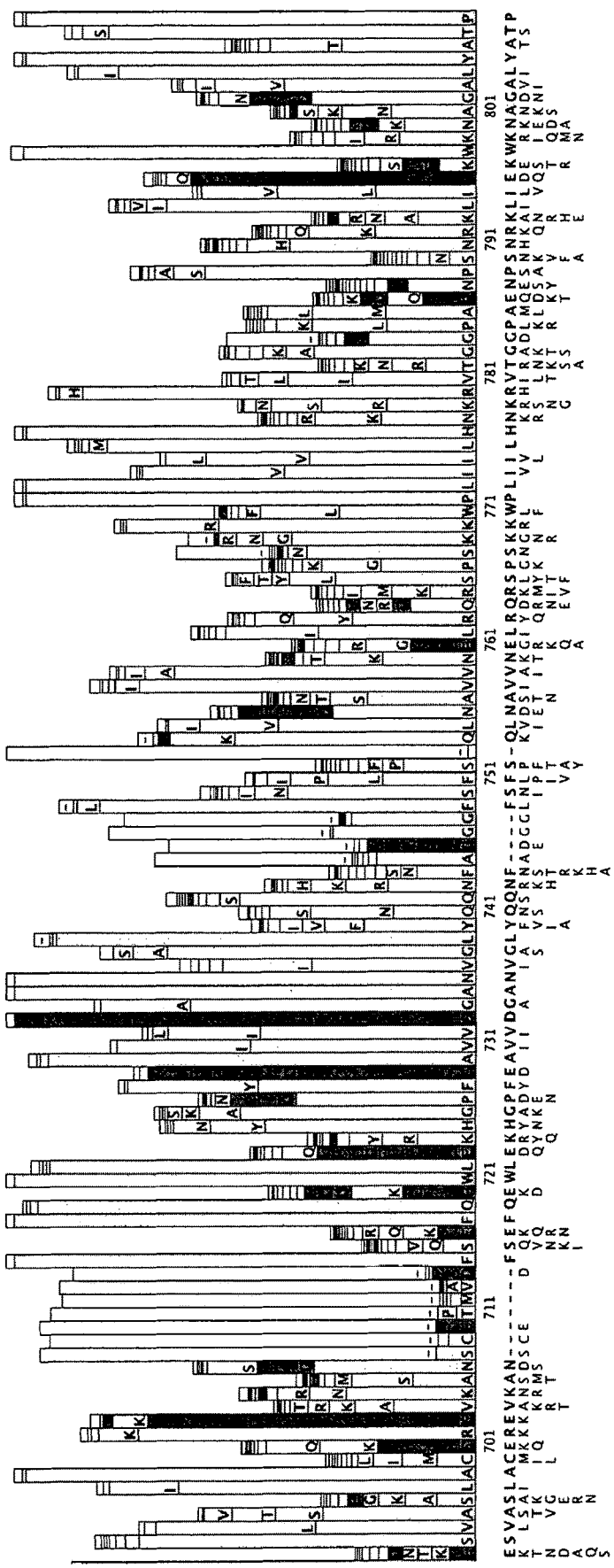
Figure 2I:
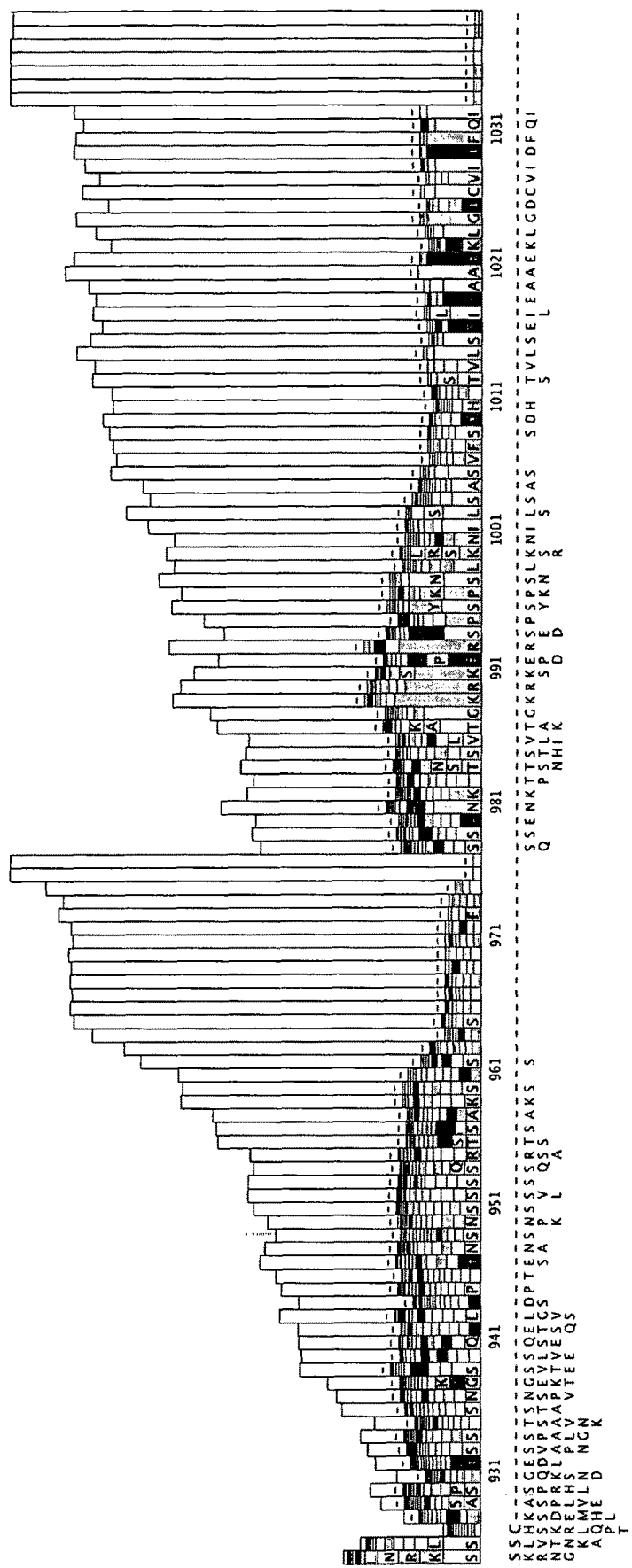

13 Claims, 14 Drawing Sheets
Specification includes a Sequence Listing.

Figure 2F

Figure 2H

A: Gel1

B: Gel 2

C: Gel 3

METHOD FOR INCREASING THE RESISTANCE OF A PLANT TO A PLANT RNA VIRUS

The present invention relates to methods for increasing the resistance of a plant to a plant RNA virus and means for obtaining RNA virus-resistant plants.

The impact of plant viruses on the reduction of crop yields is major. Its cost is estimated at 60 billion U.S. dollars annually in the world (FAO, 2012). One of the most important characteristics of plant viruses is that 80% of them are RNA viruses (Mandahar, 2006). RNA viruses infect plants of economic importance, such as wheat, corn, cabbages, tobacco, potatoes, peanuts or the cocoa tree. There is therefore a need for innovative strategies against RNA viruses that are responsible for significant declines in crop yields.

Plant RNA viruses are characterized by the frequent presence of a tRNA-like structure (TLS) at the 3' end of their genomic RNA. A tRNA-like structure is an RNA sequence mimicking a tRNA and capable of being aminoacylated by an amino acid and therefore of covalently bonding said amino acid residue at the 3' position. The aminoacylation of TLS demonstrates that their structures are sufficiently similar to those of tRNAs to be recognized by tRNA binding enzymes (see for review Dreher, 2009 and 2010). The presence of TLS and/or their aminoacylation are crucial for these viruses. Aminoacylatable 3' TLS may be involved in virus replication in the translation of their RNA and their packaging (Dreher, 2009). Work performed in vitro showed long ago that plant virus holding aminoacylatable 3' TLS could be recognized and cleaved by RNase P enzymes (Guerrier-Takada et al., 1988).

In plants, tRNAs are synthesized as of immature precursors. One of the key steps of their maturation involves the cleavage of an additional 5' nucleotide sequence. This cleavage is performed by an endonuclease called RNase P. Until very recently, all characterized RNase P were ribonucleoproteins (RNP), containing an RNA holding catalytic activity (Altman, 2007). However, a novel type of RNase P has recently been discovered in eukaryotes. This enzyme, called PRORP (protein-only RNase P), is of peptide nature and does not require RNA for its function (Gobert et al., 2010). PRORP enzymes are particularly important in plants because unlike animals or yeast, they have completely replaced RNPs for RNase P activity (Gutmann et al., 2012). PRORP enzymes are characterized by the presence of an RNA binding PPR domain, a metallonuclease domain holding the actual catalytic activity of the protein, as well as addressing sequences to the organelles (MTS) or the nucleus (NLS). In the plant model *Arabidopsis thaliana*, three PRORP enzymes are found. PRORP1 is localized in mitochondria and chloroplasts while PRORP2 and PRORP3 are located in the nucleus. Moreover, beyond tRNAs, it was shown that PRORP enzymes are capable both in vitro (Gobert et al., 2010) and in vivo (Gutmann et al., 2012) to cleave 3' tRNA-like structures (TLS).

The inventors have constructed a mutant of *A. thaliana* PRORP2 protein (At2g16650) (called CytoRP). CytoRP is the result of the deletion of the first 24 amino acids (corresponding to the nuclear localization signal domain) of PRORP2. The inventors have constructed genetically transformed *A. thaliana* plants expressing CytoRP. The selected plants expressed CytoRP which is located in the cytosol and holds RNase P activity. This activity leads to the cleavage of the aminoacylatable 3' tRNA-like structure (TLS) of plant RNA viruses and thus generates plants with increased resistance to RNA viruses.

Accordingly, the present invention provides a method for increasing the resistance of a plant to a plant RNA virus, wherein said method comprises expressing in said plant a mutant protein-only RNase P enzyme (hereinafter called CytoRP), and wherein said CytoRP:

is a protein-only RNase P enzyme comprising neither a nuclear localization signal (NLS) domain nor an organelle targeting sequence (MTS) domain, and is able to cleave the aminoacylatable 3' tRNA-like structure (TLS) of a plant RNA virus.

A protein-only RNase P enzyme (PRORP, for PROtein-only RNase P) is a protein with RNase P activity composed of an N-terminal α-super helix domain containing PPR motifs and a C-terminal NYN-type metallonuclease domain connected by a zinc-binding module (see FIG. 1, Gobert et al., 2010 and 2013; Gutmann et al., 2012; Howard et al., 2012).

N-terminal α-Super Helix Domain Containing PPR Motifs

PPR domains contain 35 amino-acid repeats involved in RNA binding. They are eukaryote-specific. The primary sequence of PPR repeats is highly degenerate but their 3D structure is conserved. Each repeat is composed of an α-helix-turn-helix structure (Lurin et al., 2004). Structural predictions of the N-terminal domains of PRORP enzymes from diverse organisms using Phyre2 (Kelley and Sternberg, 2009) are congruent with the occurrence of a conserved α-super helix corresponding to the fold of PPR proteins (Small and Peeters, 2000). Predicted numbers of PPR repeats in PRORP sequences from various organisms range from 2 to 5 according to the TPRpred prediction software (Karpenahalli et al., 2007). As inferred from footprinting data (Gobert et al., 2013) and protein truncation (Howard et al., 2012), the N-terminal part of PRORP bears the RNA recognition domain that binds conserved nucleotides and structure elements in the D- and TψC-loops of tRNAs and tRNA-like structures (Gobert et al., 2013).

C-terminal NYN-type Metallonuclease Domain

The second main domain of PRORP enzymes is a metallonuclease domain (see FIG. 1) responsible for the actual nuclease activity of these enzymes (Gobert et al., 2010; Gutmann et al., 2012; Howard et al., 2012). This catalytic domain is a PIN-like domain from the NYN family. The NYN catalytic domain seems to originate from the putative bacterial ribonuclease coded by the yacP gene and is found throughout the main branches of life, with the exception of fungi (Anantharaman and Aravind, 2006). This domain contains conserved aspartate residues, but additional conserved residues are characteristic for the PRORP sub-family and allow to discriminate between PRORP and other NYN-domain proteins. The NYN domain of PRORP is characterized by 2 subparts. The first part comprises the following signature (D/E/T/H/N/P/G)h$_3$D(G/A)xN (SEQ ID NO: 1). In this subpart of the signature, "h$_3$" correspond to hydrophobic amino acids with few exceptions where 1 out of 3 amino acids is nucleophylic. The first acidic amino acid (D/E) is highly conserved in land plants. The second subpart of the domain contains the following conserved signature DDx$_{15}$(S/T)xDx$_3$DH (SEQ ID NO: 2). The length between the first and the second sub-domain is restricted to 70-80 amino acids in land plants.

Connecting Zinc-binding Module

The PPR and NYN domains are connected by a zinc-binding module composed of 2 subparts placed upstream and downstream of the NYN domain (see FIG. 1). The first part contains a CxxC (SEQ ID NO: 3) motif strictly conserved in all PRORP sequences of land plants. This signature is found between 49 and 144 amino acid upstream of the NYN domain. The second subpart contains the following signatures (W/Y/F)HxPx (SEQ ID NO: 4), and (W/F)xCx$_{2-3}$(R/K) (SEQ ID NO: 5). The conserved C and H residues of this bi-partite module are implicated in zinc binding (Howard et al., 2012; Gobert et al., 2013).

Other Conserved Motifs of PRORP

Further signatures are presents in specific phyla. In land plants, a stretch of three to four glycines (Gs) separates the protein between the two main domains just before the zinc-binding module (see FIG. 1). Charged residues upstream of the Gs face the outside of PRORP structure and it might be involved in protein/protein interactions. In addition, a motif generally composed of MPxP(Y/F/C)(S/T) (SEQ ID NO: 6) is present between the NYN domain and the C-terminal part of the zinc-binding module (see FIG. 1).

PRORP MTS and NLS Domains

PRORP MTS sequences are N-terminal amphiphilic α-helices structures. Their occurrence can be predicted by softwares such as Predotar (Small et al., 2004) or TargetP (Emanuelsson et al., 2000). PRORP NLS sequences are mono or bi-partite sequences located most of the times in the N-terminal and/or C-terminal parts of proteins, characterized by the frequent occurrence of basic residues such as Lysines and Arginines. Their occurrence can be predicted by softwares such as NLStradamus (Nguyen Ba et al., 2009).

Numbering of Important Positions in *Arabidopsis* PRORP2 (SEQ ID NO: 105)

The nuclear localization signal of AtPRORP2 is composed of residues 1 to 24.

Among the 5 PPR repeats found in AtPRORP2, the positions L34, S65, Q70, N108, S114, R145, A150, E180, S185, S215 are predicted to be important for RNA substrate recognition, according to the proposed PPR/RNA recognition code (Barkan et al., 2012).

The bi-partite zinc-binding motif contains residues C281 and C284 in the middle of AtPRORP2 sequence and residues W493, H494, P496, C511 and R514 at the C-terminal end of AtPRORP2 sequence.

In the conserved NYN domain, residues E339, D343, D421, D422, D440, D444 and H445 are predicted to be of high functional importance. Residues D421 and D422 were already shown to be essential for catalytic activity (Gutmann et al., 2012).

Other motifs are characteristic of plant AtPRORP enzymes. Among them, a motif composed by G254, G255 and G256 is present in AtPRORP2. Another motif of unknown function contains the conserved M477 and S482.

Methods for Retrieving PRORPs

PRORP sequences can be retrieved using the BLAST tool (Altschul et al., 1990) in the following databases:

NCBI ("Blast"),
Ensembl ("blastview"),
Bogas ("webtools/bogas"),
Phytozome ("phytozome"),
JGI and/or
Broad Institute ("scientific-community data").

The sequences can be aligned using Muscle (EMBL-EBI) (Edgar, 2004) before using WebLogo 3 ((Crooks et al., 2004),) to highlight the conserved residues.

Advantageously, the protein-only RNase P enzyme contains the residues G254, G255, G256, C281, C284, E339, D343, D421, D422, D440, D444, H445, M477, S482, W493, H494, P496, C511 and R514, and eventually at least one of the residues selected from the group consisting of L34, S65, Q70, N108, S114, R145, A150, E180, 5185 and 5215, numbered according to *A. thaliana* PRORP2 sequence represented as SEQ ID NO: 105.

Advantageously, the protein-only RNase P enzyme has the consensus amino acid sequence described in FIG. 2 (SEQ ID NO: 7).

Advantageously, the protein-only RNase P enzyme is from a land plant, such as a PRORP enzyme selected from the group consisting of *Oryza sativa* (rice) SEQ ID NO: 8, 9 or 10; *Zea mays* (corn) SEQ ID NO: 11, 12 or 13; *Triticum turgidum* (wheat) SEQ ID NO: 14 or 15; *Solanum lycopersicum* (tomato) SEQ ID NO: 16, 17 or 18; *Brassica rapa* (turnip) SEQ ID NO: 19, 20 or 21; *Carica papaya* (papaya) SEQ ID NO: 22, 23 or 24; *Solanum tuberosum* (potato) SEQ ID NO: 25, 26 or 27; *Nicotiana tabacum* (tobacco) SEQ ID NO: 28, 29 or 30; *Setaria* (millet) SEQ ID NO: 31, 32 or 33; *Sorghum bicolor* (sorghum) SEQ ID NO: 34, 35, 36 or 37; *Hordeum vulgare* (barley) SEQ ID NO: 38 or 39; *Oryza officinalis* (rice) SEQ ID NO: 40; *Manihot esculenta* (manioc) SEQ ID NO: 41, 42 or 43; *Theobroma cacao* (cocoa) SEQ ID NO: 44, 45 or 46; *Cucumis sativus* (cucumber) SEQ ID NO: 47, 48 or 49; *Vitis vinifera* (vine) SEQ ID NO: 50, 51, 52 or 53; *Glycine max* (soybean) SEQ ID NO: 54, 55, 56, 57 or 58; *Prunus persica* (peach) SEQ ID NO: 59, 60 or 61; *Malus domestica* (apple) SEQ ID NO: 62, 63 or 64; *Fragaria vesca* (strawberry) SEQ ID NO: 65, 66 or 67; *Citrus clementina* (clementine) SEQ ID NO: 68, 69 or 70; *Citrus sinensis* (orange) SEQ ID NO: 71, 72 or 73; *Populus trichocarpa* (poplar) SEQ ID NO: 74, 75, 76, 77 or 78; *Eucalyptus* SEQ ID NO: 79, 80 or 81; *Ricinus communis* (ricinus) SEQ ID NO: 82, 83 or 84; *Medicago sativa* (alfalfa/lucerne) SEQ ID NO: 85, 86 or 87; Lotus SEQ ID NO: 88 or 89; *Aquilegia* (columbine) SEQ ID NO: 90, 91 or 92; *Eutrema halophila* SEQ ID NO: 93, 94 or 95; *Eutrema parvulum* SEQ ID NO: 96, 97 or 98; *Mimulus* (monkey-flower) SEQ ID NO: 99, 100, 101 or 102; *Jatropha* SEQ ID NO: 103; *Arabidopsis thaliana* SEQ ID NO: 104, 105 or 106; *Arabidopsis lyrata* SEQ ID NO: 107, 108 or 109; *Brachypodium* SEQ ID NO: 110, 111 or 112; *Physcomitrella patens* SEQ ID NO: 113, 114 or 115; *Selaginella moellendorffii* SEQ ID NO: 116 or 117; and a PRORP enzyme comprising the *Brassica napus* (rapeseed) sequence SEQ ID NO: 118, 119 or 120.

According to a preferred embodiment of the invention, the mutant protein-only RNase P enzyme (CytoRP) is able to cleave the aminoacylatable 3' tRNA-like structure (TLS) of a plant RNA virus belonging to a genus selected from the group consisting of Tymovirus, Furovirus, Pomovirus, Pecluvirus, Tobamovirus, Bromovirus, Cucumovirus and Hordeivirus. More preferably CytoRP is able to cleave the aminoacylatable 3' TLS of a plant RNA virus selected from the group consisting of Turnip yellow mosaic virus (TYMV), Andean potato latent virus (APLV), Belladonna mottle virus (BeMV), Cacao yellow mosaic virus (CYMV), Clitoria yellow vein virus (CYVV), Eggplant mosaic virus (EMV), Kennedya yellow mosaic virus (KYMV), Okra mosaic virus (OkMV), Ononis yellow mosaic virus (OYMV), Wild cucumber mosaic virus (WCMV), Nemesia ring necrosis virus (NeRNV), Soil-borne wheat mosaic virus (SBWMV), Beet soil-borne virus (BSBV), Potato mop-top virus (PMTV), Indian peanut clump virus (IPCV), Peanut clump virus (PCV), Tobacco mosaic virus (TMV), Cucumber green mottle mosaic virus (CGMMV), Green tomato atypical mosaic virus (GTAMV), Satellite tobacco mosaic virus (STMV), Sunnhemp mosaic virus (SHMV), Brome mosaic virus (BMV), Broad bean mottle virus (BBMV), Cowpea chlorotic mottle virus (CCMV), Cucumber mosaic virus (CMV), Barley stripe mosaic virus (BSMV) and Poa semilatent virus (PSLV). More preferably CytoRP is able to cleave the aminoacylatable 3' TLS of a plant RNA virus selected from the group consisting of TYMV, TMV and BMV.

The aminoacylatable 3' TLS of the above-mentioned plant RNA viruses is known in the art (see for review Dreher, 2010).

By way of example, the nucleotide sequence of the aminoacylatable 3' TLS of the TYMV is represented as SEQ ID NO: 237, of the TMV is represented as SEQ ID NO: 238, and of the BMV is represented as SEQ ID NO: 239.

The cleavage of the aminoacylatable 3' tRNA-like structure (TLS) of a plant RNA virus by a mutant protein-only RNase P enzyme (CytoRP) according to the present invention can be determined in vitro. In vitro cleavage assays are described in the Examples below, in Gobert et al., 2010 and in Gutmann et al., 2012.

According to another preferred embodiment of the invention, the mutant protein-only RNase P enzyme (CytoRP) has at least 50% identity, or by order of increasing preference at least 55%, 60%, 65%, 70%, 75%, 80%, 85%, 90%, 91%, 92%, 93%, 94%, 95%, 96%, 97%, 98% or 99% identity with a polypeptide of sequence selected from the group consisting of SEQ ID NO: 121, 122 or 123 (mutants of PRORP enzymes from *Oryza sativa* wherein the NLS or MTS domain is deleted); SEQ ID NO: 124, 125 or 126 (mutants of PRORP enzymes from *Zea mays* wherein the NLS or MTS domain is deleted); SEQ ID NO: 127 or 128 (mutants of PRORP enzymes from *Triticum turgidum*); SEQ ID NO: 129, 130 or 131 (mutants of PRORP enzymes from *Solanum lycopersicum* wherein the NLS or MTS domain is deleted); SEQ ID NO: 132, 133 or 134 (mutants of PRORP enzymes from *Brassica rapa* wherein the NLS or MTS domain is deleted); SEQ ID NO: 135, 136 or 137 (mutants of PRORP enzymes from *Carica papaya* wherein the NLS or MTS domain is deleted); SEQ ID NO: 138, 139 or 140 (mutants of PRORP enzymes from *Solanum tuberosum* wherein the NLS or MTS domain is deleted); SEQ ID NO: 141, 142 or 143 (mutants of PRORP enzymes from *Nicotiana tabacum* wherein the NLS or MTS domain is deleted); SEQ ID NO: 144, 145 or 146 (mutants of PRORP enzymes from *Setaria* wherein the NLS domain is deleted); SEQ ID NO: 147, 148, 149 or 150 (mutants of PRORP enzymes from *Sorghum bicolor* wherein the NLS domain is deleted); SEQ ID NO: 151 or 152 (mutants of PRORP enzymes from *Hordeum vulgare* wherein the NLS or MTS domain is deleted); SEQ ID NO: 153 (mutant of PRORP enzyme from *Oryza officinalis* wherein the NLS domain is deleted); SEQ ID NO: 154, 155 or 156 (mutants of PRORP enzymes from *Manihot esculenta* wherein the NLS or MTS domain is deleted); SEQ ID NO: 157, 158 or 159 (mutants of PRORP enzymes from *Theobroma cacao* wherein the NLS or MTS domain is deleted); SEQ ID NO: 160, 161 or 162 (mutants of PRORP enzymes from *Cucumis sativus* wherein the NLS or MTS domain is deleted); SEQ ID NO: 163, 164, 165 or 166 (mutants of PRORP enzymes from *Vitis vinifera* wherein the NLS or MTS domain is deleted); SEQ ID NO: 167, 168, 169, 170 or 171 (mutants of PRORP enzymes from *Glycine max* wherein the NLS or MTS domain is deleted); SEQ ID NO: 172, 173 or 174 (mutants of PRORP enzymes from *Prunus persica* wherein the NLS or MTS domain is deleted); SEQ ID NO: 175, 176 or 177 (mutants of PRORP enzymes from *Malus domestica* wherein the NLS or MTS domain is deleted); SEQ ID NO: 178, 179 or 180 (mutants of PRORP enzymes from *Fragaria vesca* wherein the NLS or MTS domain is deleted); SEQ ID NO: 181, 182 or 183 (mutants of PRORP enzymes from *Citrus clementina* wherein the NLS domain is deleted); SEQ ID NO: 184, 185 or 186 (mutants of PRORP enzymes from *Citrus sinensis* wherein the NLS domain is deleted); SEQ ID NO: 187, 188, 189, 190 or 191 (mutants of PRORP enzymes from *Populus trichocarpa* wherein the NLS or MTS domain is deleted); SEQ ID NO: 192, 193 or 194 (mutants of PRORP enzymes from *Eucalyptus* wherein the NLS or MTS domain is deleted); SEQ ID NO: 195, 196 or 197 (mutants of PRORP enzymes from *Ricinus communis* wherein the NLS or MTS domain is deleted); SEQ ID NO: 198, 199 or 200 (mutants of PRORP enzymes from *Medicago sativa* wherein the NLS or MTS domain is deleted); SEQ ID NO: 201 or 202 (mutants of PRORP enzymes from Lotus wherein the MTS domain is deleted); SEQ ID NO: 203, 204 or 205 (mutants of PRORP enzymes from *Aquilegia* wherein the NLS or MTS domain is deleted); SEQ ID NO: 206, 207 or 208 (mutants of PRORP enzymes from *Eutrema halophila* wherein the NLS or MTS domain is deleted); SEQ ID NO: 209, 210 or 211 (mutants of PRORP enzymes from *Eutrema parvulum* wherein the NLS or MTS domain is deleted); SEQ ID NO: 212, 213, 214 or 215 (mutants of PRORP enzymes from *Mimulus* wherein the NLS or MTS domain is deleted); SEQ ID NO: 216 (mutant of PRORP enzyme from *Jatropha* wherein the NLS domain is deleted); SEQ ID NO: 217, 218 or 219 (mutants of PRORP enzymes from *Arabidopsis thaliana* wherein the NLS or MTS domain is deleted); SEQ ID NO: 220, 221 or 222 (mutants of PRORP enzymes from *Arabidopsis lyrata* wherein the NLS or MTS domain is deleted); SEQ ID NO: 223, 224 or 225 (mutants of PRORP enzymes from *Brachypodium* wherein the NLS or MTS domain is deleted); SEQ ID NO: 226, 227 or 228 (mutants of PRORP enzymes from *Physcomitrella patens* wherein the NLS or MTS domain is deleted); and SEQ ID NO: 229 or 230 (mutants of PRORP enzymes from *Selaginella moellendorffii* wherein the NLS or MTS domain is deleted).

Unless otherwise specified, the protein sequence identity values provided herein are calculated using the BLASTP program under default parameters, on a comparison window including the whole sequence of the proteins to be compared.

Advantageously, CytoRP consists in an amino acid sequence selected from the group consisting of SEQ ID NO: 121 to 230.

According to another preferred embodiment of the invention, CytoRP is a mutant of an endogenous protein-only RNase P enzyme from said plant to which the method of the invention is applied.

According to another preferred embodiment of the invention, the method is for increasing the resistance of a plant to a plant RNA virus belonging to a genus selected from the group consisting of Tymovirus, Furovirus, Pomovirus, Pecluvirus, Tobamovirus, Bromovirus, Cucumovirus and Hordeivirus. In particular, said plant RNA virus is selected from the group consisting of Turnip yellow mosaic virus (TYMV), Andean potato latent virus (APLV), Belladonna mottle virus (BeMV), Cacao yellow mosaic virus (CYMV), Clitoria yellow vein virus (CYVV), Eggplant mosaic virus (EMV), Kennedya yellow mosaic virus (KYMV), Okra mosaic virus (OkMV), Ononis yellow mosaic virus (OYMV), Wild cucumber mosaic virus (WCMV), Nemesia ring necrosis virus (NeRNV), Soil-borne wheat mosaic virus (SBWMV), Beet soil-borne virus (BSBV), Potato mop-top virus (PMTV), Indian peanut clump virus (IPCV), Peanut clump virus (PCV), Tobacco mosaic virus (TMV), Cucumber green mottle mosaic virus (CGMMV), Green tomato atypical mosaic virus (GTAMV), Satellite tobacco mosaic virus (STMV), Sunnhemp mosaic virus (SHMV), Brome mosaic virus (BMV), Broad bean mottle virus (BBMV), Cowpea chlorotic mottle virus (CCMV), Cucumber mosaic virus (CMV), Barley stripe mosaic virus (BSMV), Poa semilatent virus (PSLV).

The term "plant" includes any monocotyledon or dicotyledon plant.

Advantageously, the invention applies to plants of agronomical interest, such as rice, corn, wheat, tomato, turnip, *papaya*, rapeseed, potato, tobacco, millet, *sorghum*, barley, manioc, cocoa, cucumber, vine, soybean, peach, apple, strawberry, clementine, orange, poplar, *eucalyptus, ricinus*, alfalfa (lucerne), lotus, carrot, pepper, aubergine, zucchini, melon, bean, spinach, lettuce, onion, celery, beet, squash and strawberry, preferably potato, potato, cucumber, tobacco, carrot, pepper, aubergine, zucchini, melon, bean, spinach, lettuce, celery, beet, squash and strawberry, more preferably tobacco, cucumber, tomato, lettuce and onion.

A preferred method for expressing a mutant protein-only RNase P enzyme (CytoRP) according to the present invention comprises introducing into the genome of said plant a DNA construct comprising a nucleotide sequence encoding said CytoRP, placed under control of a promoter.

The instant invention also provides means for expressing a mutant protein-only RNase P enzyme (CytoRP).

This included an isolated polynucleotide encoding a CytoRP as defined above.

This also includes recombinant DNA constructs for expressing a CytoRP enzyme in a host-cell (e.g., bacteria or plant cell) or a whole plant. These recombinant DNA constructs can be obtained and introduced in said host cell or whole plant by well known techniques of recombinant DNA and genetic engineering.

Recombinant DNA constructs of the invention include expression cassettes, comprising a polynucleotide encoding a CytoRP as defined above, under control of a transcription promoter functional in a host cell (e.g., bacteria or plant cell).

Said transcription promoter may be any promoter that is functional in a cell, preferably a plant cell, i.e., capable of directing the transcription of a polynucleotide encoding a CytoRP as defined above in a cell, preferably a plant cell (for review, see Yoshida and Shinmyo, 2000). The choice of the most appropriate promoter depends in particular on the organ(s) or on the tissue(s) targeted for the expression. The promoter may be a constitutive promoter (i.e., a promoter which is active in most tissues and cells and under most environmental conditions), a cell-type-specific promoter (i.e., a promoter which is active only or mainly in certain tissues or certain types of cells) or an inducible promoter (i.e., a promoter which is activated by physical processes or chemical stimuli). The promoter may also be the promoter of a PRORP gene, such as the *A. thaliana* PRORP2 promoter included in SEQ ID NO: 231.

By way of non-limiting examples of constitutive promoters which are commonly used in plant cells, mention may be made of the cauliflower mosaic virus (CaMV) 35S promoter, the NOS (nopaline synthase) promoter, the PG10-90 synthetic promoter, preferably the 35S promoter.

By way of non-limiting examples of organ-specific or tissue-specific promoters, mention may be made of promoters such as the pollen specific APRS promoter, the embryo specific MXL promoter (Jopcik et al., 2013) or any plant promoter as listed in the plant promoter database PlantProm (Shahmuradov et al., 2003).

By way of non-limiting examples of inducible promoters, mention may be made of the ethanol inducible AlcR/AlcA and the β-estradiol inducible XVE/OlexA inducible systems (Borghi, 2010).

Said recombinant expression cassette may also comprise a transcription terminator, such as, for example, the CaMV 35S terminator, the NOS terminator or the T9 terminator of the rbcS E9 gene. The terminator may also be the terminator of a PRORP gene, such as the *A. thaliana* PRORP2 terminator included in SEQ ID NO: 232.

Said recombinant expression cassette may also include other regulatory sequences, such as transcription enhancer sequences.

Recombinant DNA constructs of the invention also include recombinant vectors containing an expression cassette comprising a polynucleotide encoding a CytoRP as defined above. In particular said expression cassette is a recombinant expression cassette of the invention, wherein the polynucleotide encoding a CytoRP is under control of a promoter of a PRORP gene.

The expression cassettes and the expression vectors according to the invention may also comprise other sequences, usually employed in constructs of this type, such as translation leader (TL) sequences, polyadenylation sites, and also, where appropriate, amplifying sequences (transcription enhancer sequences). They may also comprise sequences which make it possible to monitor the transformation, and also to identify and/or to select the cells or organisms transformed. These are, in particular, reporter genes (for example the beta-glucuronidase (GUS) gene, the luciferase gene or the green fluorescent protein (GFP) gene, conferring an easily recognizable phenotype on these cells or organisms, or else selection marker genes (for example, genes for resistance to an antibiotic, such as kanamycin or hygromycin, or to an herbicide).

The choice of the promoter and of the additional sequences that can be inserted into the expression cassettes and vectors according to the invention can be made, conventionally, by a person skilled in the art according in particular to criteria such as the host vector, host cells and organisms chosen, the desired expression profile in the host cell or organism, the genetic transformation protocols envisioned, etc.

The selection of suitable vectors and the methods for inserting DNA constructs therein are well known to a person skilled in the art. The choice of the vector depends on the intended host and on the intended method of transformation of said host.

A variety of techniques for genetic transformation of plant cells or plants are available in the art. By way of non-limiting examples, one can mention methods of direct transfer of genes such as direct micro-injection into plant embryoids, vacuum infiltration or electroporation, or the bombardment by gun of particules covered with the plasmidic DNA of interest. *Agrobacterium* mediated transformation methods may also be used such as *Agrobacterium tumefaciens* or *Agrobacterium rhizogenes*.

The present invention also provides a host cell comprising an expression cassette or a recombinant vector as defined above.

The host cells can be prokaryotic or eukaryotic cells. In the case of prokaryotic cells, they may be agrobacteria such as *Agrobacterium tumefaciens* or *Agrobacterium rhizobium*. In the case of eukaryotic cells, they may be plant cells stemming from dicotyledonous or monocotyledonous plants.

The invention also provides a method for producing a transgenic plant, having an increased resistance to a plant RNA virus.

Various methods for obtaining transgenic plants are well known in themselves to a person skilled in the art.

In particular, said method comprises transforming a plant cell by a DNA construct of the invention and regenerating from said plant cell a transgenic plant expressing a CytoRP as defined above.

According to a preferred embodiment of this, it comprises transforming a plant cell with a recombinant vector of the invention comprising a polynucleotide encoding a CytoRP as defined above, and regenerating from said plant cell a transgenic plant expressing a CytoRP.

A very large number of techniques for transforming plant germinal or somatic cells (isolated, in the form of tissue or organ cultures, or on the whole plant), and regenerating the plants are available. The choice of the most suitable method generally depends on the plant concerned.

The invention also comprises plants genetically transformed by a recombinant DNA construct of the invention, such as an expression cassette, and expressing a CytoRP as defined above, and in particular transgenic plants comprising, in their nuclear genome, at least one copy of a transgene containing a recombinant DNA construct of the invention according to the invention. In said transgenic plants a DNA construct of the invention is comprised in a transgene stably integrated in the plant genome, so that it is passed onto successive plant generations. Thus the transgenic plants of the invention include not only the plants resulting from the initial transgenesis, but also their descendants, as far as they contain a recombinant DNA construct of the invention. The expression of a CytoRP as defined above in said plants provides them an increased resistance to a plant RNA virus, when compared with a wild-type plant devoid of said transgene(s).

The invention also comprises a transgenic plant, obtainable by a method of the invention, expressing a CytoRP as defined above, said plant containing a recombinant expression cassette of the invention.

The invention further comprises a transgenic plant or an isolated organ or tissue thereof (such as seeds, leafs, flowers, roots, stems, ears) comprising, stably integrated in its genome, a recombinant expression cassette comprising a polynucleotide encoding a CytoRP as defined above.

The present invention also provides an isolated mutant protein-only RNase P enzyme (CytoRP) comprising neither a nuclear localization signal (NLS) domain nor an organelle targeting sequence (MTS) domain, and able to cleave the aminoacylatable 3' tRNA-like structure (TLS) of a plant RNA virus, as defined above.

Advantageously, CytoRP has at least 50% identity, or by order of increasing preference at least 55%, 60%, 65%, 70%, 75%, 80%, 85%, 90%, 91%, 92%, 93%, 94%, 95%, 96%, 97%, 98% or 99% identity with a polypeptide of sequence selected from the group consisting of SEQ ID NO: 121 to 230.

The present invention also provides the use of an isolated polynucleotide encoding a CyroRP as defined above for producing a transgenic plant having an increased resistance to a plant RNA virus as defined above.

Foregoing and other objects and advantages of the invention will become more apparent from the following detailed description and accompanying drawing, which refers to non-limiting examples illustrating the use of a CytoRP for increasing the resistance of a plant to a plant RNA virus. It is to be understood however that this foregoing detailed description is exemplary only and is not restrictive of the invention.

FIG. 1: Features defining PRORP enzymes. Schematic representation of a PRORP enzyme with residues predicted to play an important role highlighted and numbered according to *Arabidopsis* PRORP2 sequence.

Figure 2F:
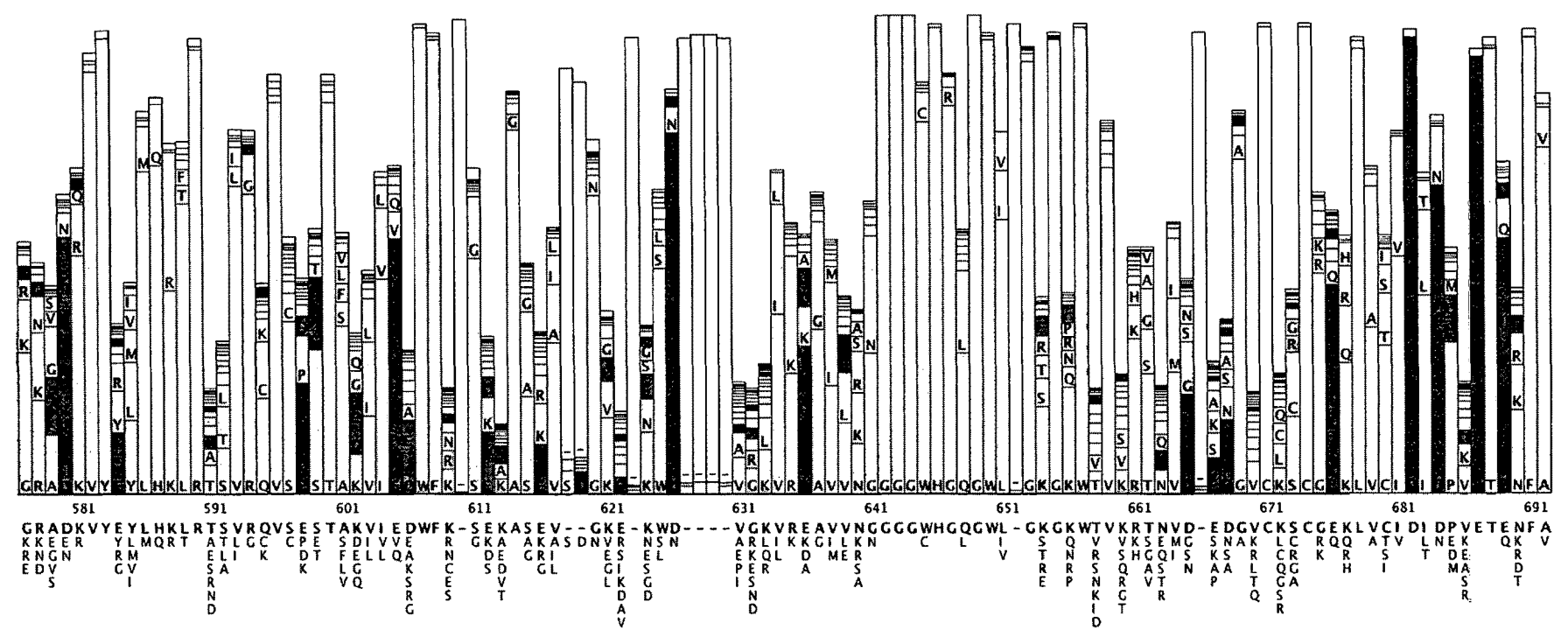
Figure 2H:
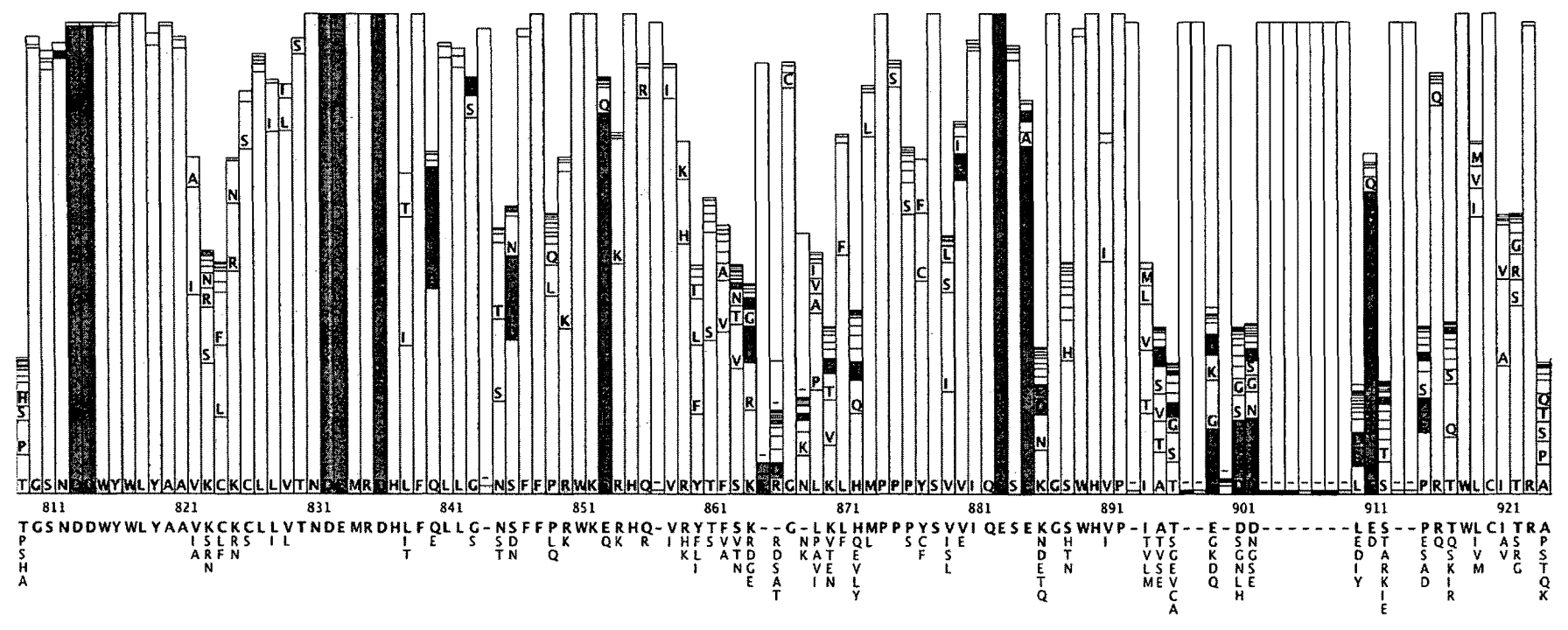

FIG. 2 (A-I) Schematic representation of residue frequency at each position in an alignment of 91 plant PRORP sequences, representing the consensus amino acid sequence of PRORP set forth in SEQ ID NO: 7. The alignment has been obtained with the software LogoBar (Pérez-Bercoff et al., 2006).

Figure 3:
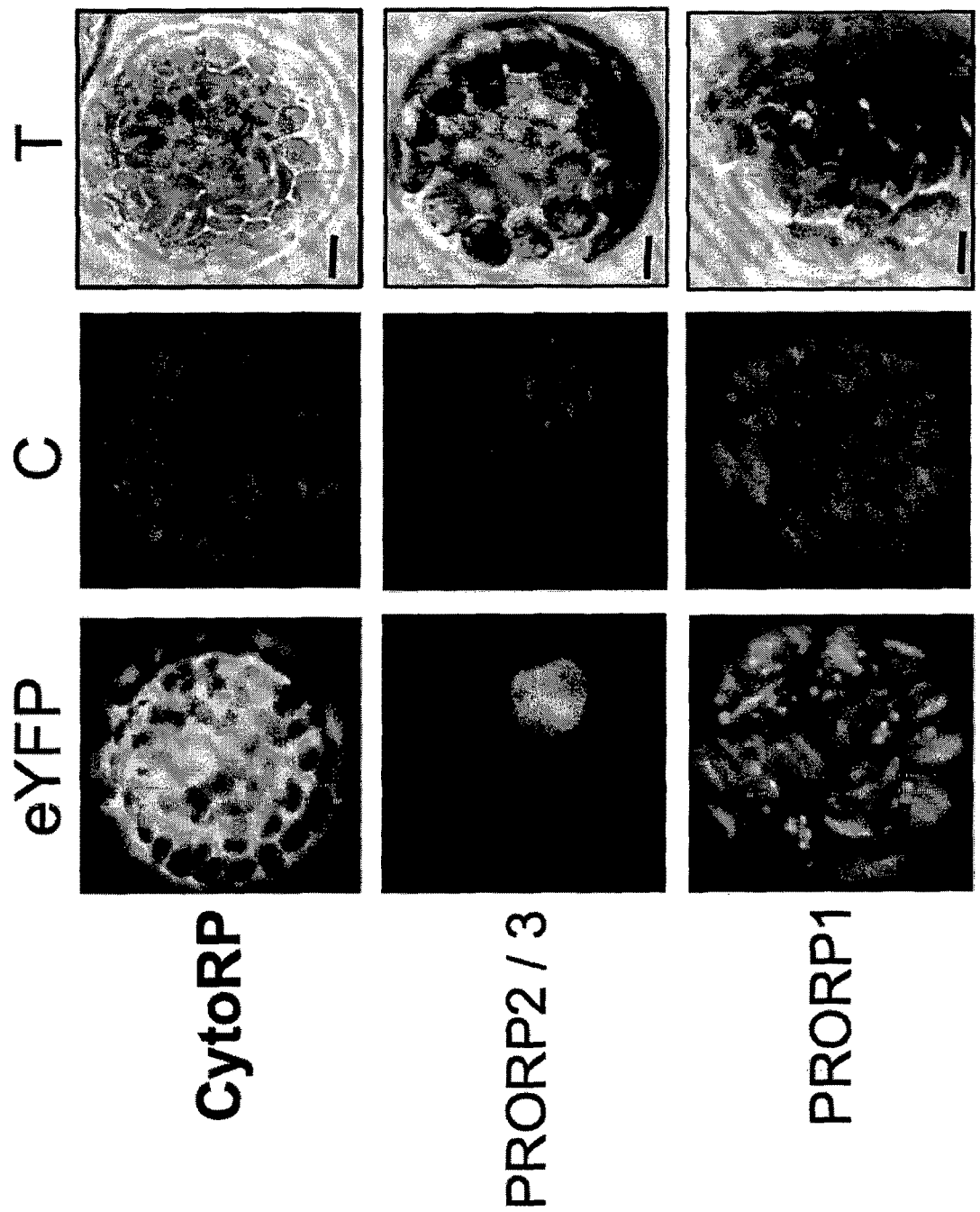

FIG. 3: The fusion of CytoRP with eYFP observed by confocal microscopy shows the cytosolic localization of CytoRP. This location differs from the nuclear localization of PRORP2/3 and the organellar localization of PRORP1 (Gobert et al., 2010). "C" shows location controls with the auto-fluorescence of chlorophyll revealing chloroplasts and DAPI staining (for PRORP2/3) revealing DNA in the nucleus. "T" shows cells in transmitted light.

Figure 4:
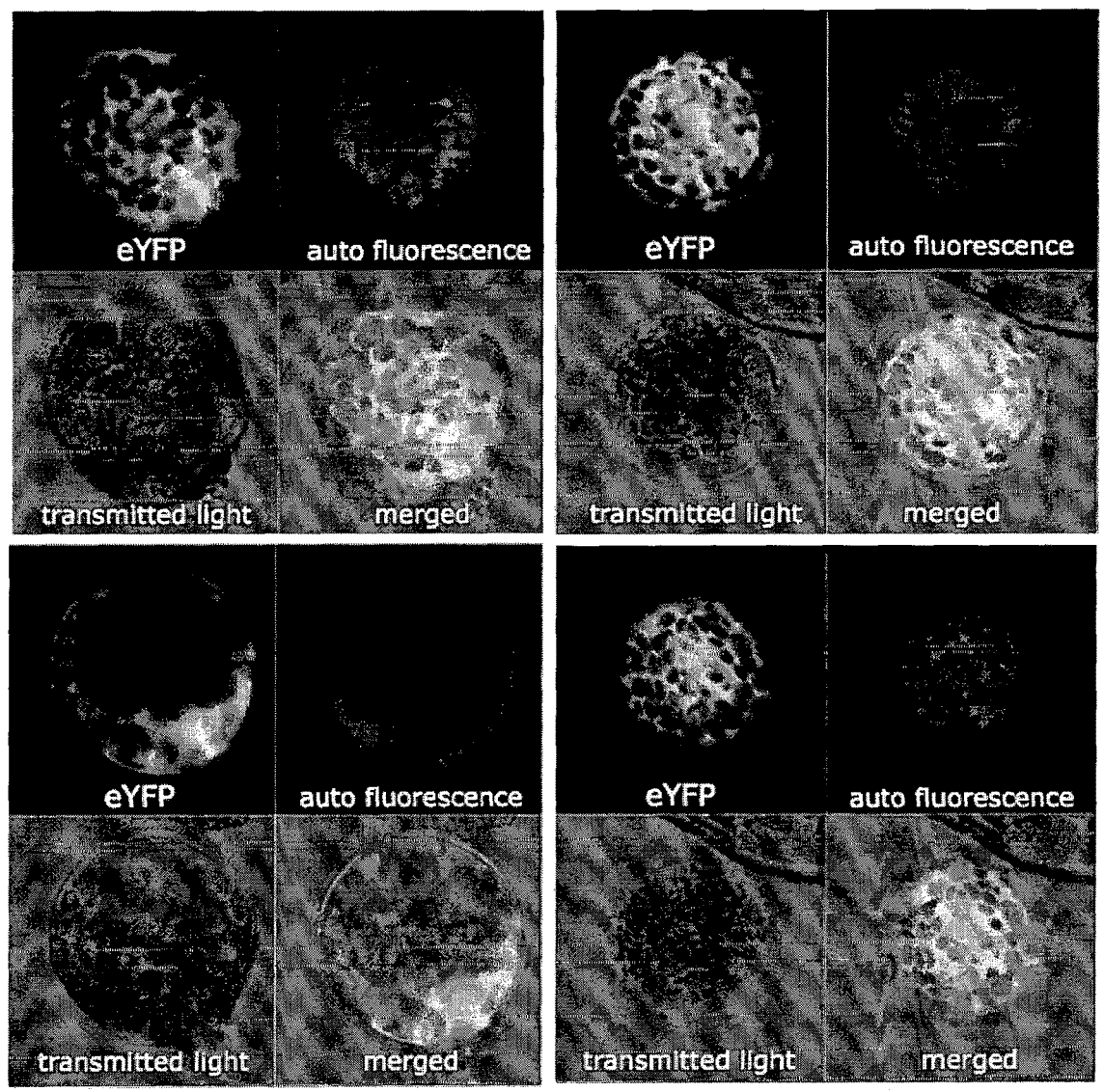

FIG. 4: Cytosolic localization of CytoRP (mutant AtPRORP2 wherein the NLS domain is deleted) determined by laser scanning confocal microscopy. Four representative experiments are shown where the construct expressing CytoRP-eYFP fusion was transformed into *Arabidopsis* protoplasts. In each experiment, the respective panels show for each cell, the eYFP signal, the autofluorescence of chlorophyll showing chloroplasts, the transmitted light image of cells and the merged image of the eYFP and the autofluorescence channels.

Figure 5:
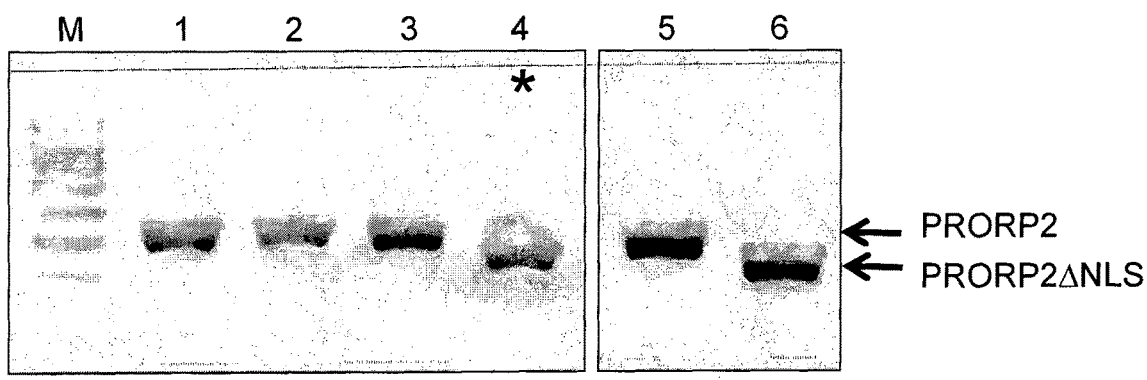

FIG. 5: Transformed plants encoding CytoRP (mutant AtPRORP2 wherein the NLS domain is deleted) were identified by PCR using total genomic DNA from plant extracts and oligonucleotides P2-5'UTR-F (SEQ ID NO: 135) and P2-R (SEQ ID NO: 136) present in AtPRORP2 5' UTR region and in its coding region respectively. Lanes 1, 2, 3 and 4 correspond to PCR reactions performed on plant genomic DNA. Lanes 5 and 6 correspond to PCR reactions performed on cDNA clones representing PRORP2 and PRORP2ΔNLS (CytoRP) respectively, serving as PCR positive controls and size references. M shows the molecular weight marker. DNA fragments were separated on a 1% agarose gel, stained with ethidium bromide and visualised under UV light. 1, 2 and 3 correspond to wild type plants that encode PRORP2, whereas 4, highlighted by an asterisk, corresponds to a CytoRP plant that expresses PRORP2ΔNLS.

Figure 6:
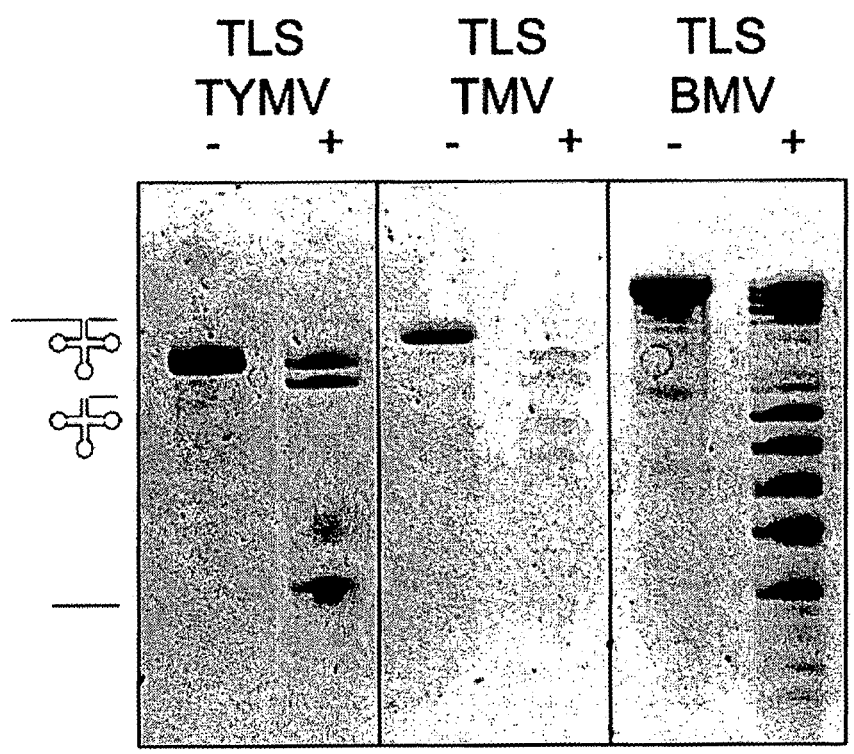

FIG. 6: RNase P activity assays of *Arabidopsis* CytoRP on in vitro synthesized transcripts representing tRNA like structures of plant viruses TYMV, TMV and BMV. (−) indicate lanes with TLS transcripts alone and (+) indicate lanes where transcripts were incubated with CytoRP proteins resulting in specific cleavage patterns.

Figure 7:
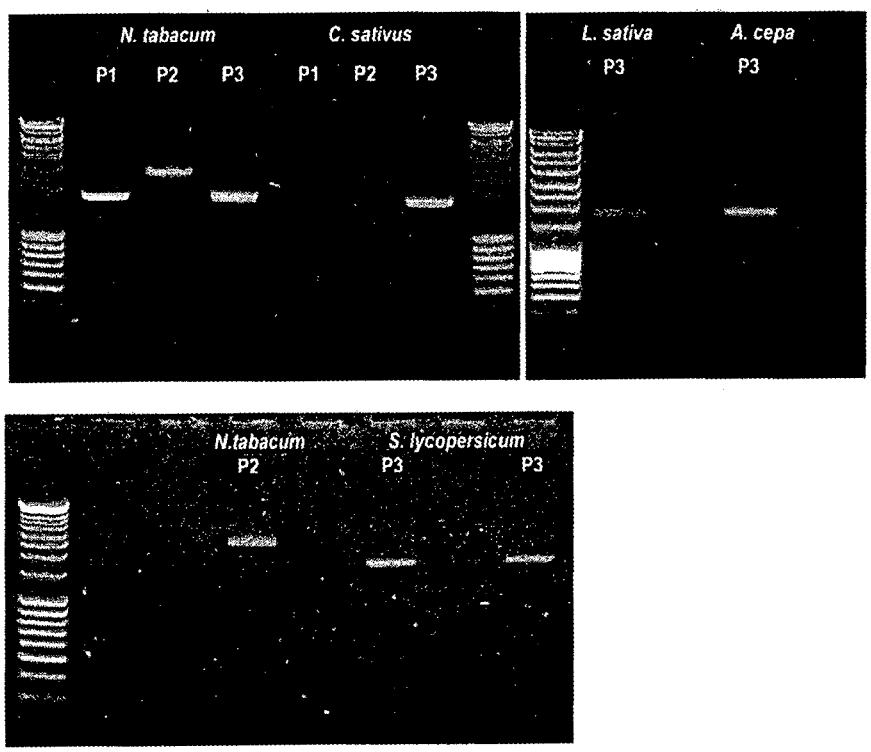

FIG. 7: PCR sample of 2 µl (from the 50 µl) mixed with water (3 µl) and 6×DNA loading dye (1 µl) and charged into a 1% agarose gel. 4.5 µl MassRuler (Thermo Scientific) was used for size determination. P=PRORP.

Figure 8:
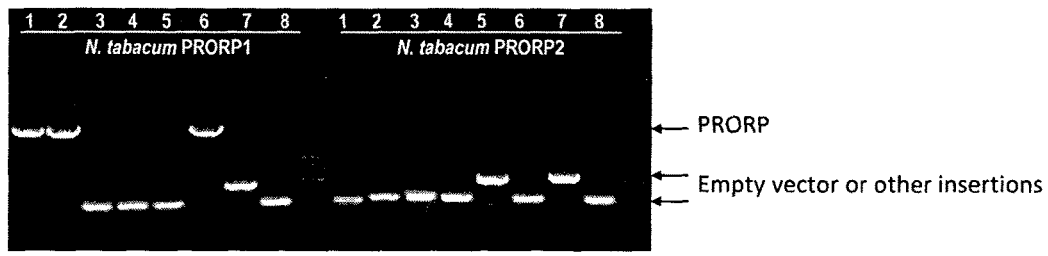
Figure 8:
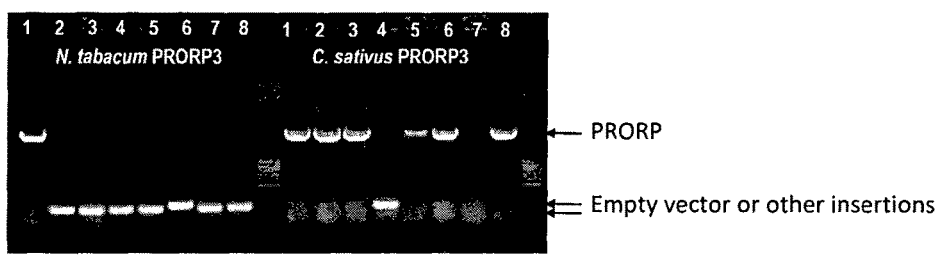
Figure 8:
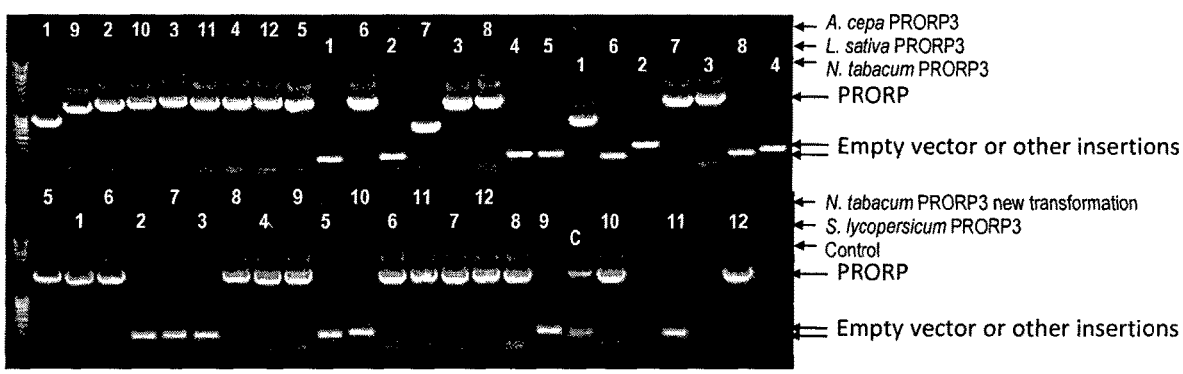

FIG. 8: 1% agarose gel is prepared and 5 µl PCR product was loaded. 4.5 µl Mass-Ruler was added for size determination. (A) Gel 1 shows for *N. tabacum* PRORP1 that colonies 1, 2 and 6 have the right size amplification for NtPRORP1, for *N. tabacum* PRORP2 that none of the colonies have NtPRORP2. (B) Gel 2 shows for *N. tabacum* PRORP3 that colony 1 has the right size amplification for NtPRORP3, for *C. sativus* PRORP3 that colonies 1, 2, 3, 5, 6 and 8 have the right size amplification for CsPRORP3. (C)

Gel 3 shows for *A. cepa* PRORP3 that colonies 2, 3, 4, 5, 6, 8, 10, 11, 12 have about the right size amplification for CsPRORP3, for *L. sativa* PRORP3 that colonies 3 and 7 have the right size amplification for LSPRORP3, for a new transformation of pGEM-T easy:*N. tabacum* PRORP3 in *E. coli* TOP10 that colonies 3, 5, 6, 8, 9, 11, 12 have the right size amplification for NtPRORP3, for *S. lycopersicum* PRORP3 that colonies 1, 4, 6, 7, 8, 10 and 12 have the right size amplification for S1PRORP3.

EXAMPLE I

Experimental Validation of the Use of Cytorp for Increasing the Resistance of a Plant to a Plant Rna Virus 1. Methods CytoRP Enzyme The CytoRP protein (SEQ ID NO: 218), whose construction is described here, derives from the *Arabidopsis* PRORP2 protein (At2g16650). Its coding sequence corresponds to nucleotides 73 to 1587 of the native PRORP2 cDNA, preceded by an ATG initiation codon. CytoRP is the result of the deletion of the first 24 amino acids of PRORP2 (corresponding to the NLS domain). CytoRP is a protein of 505 amino acids with a molecular weight of 56539.73 Da with an isoelectric point of 7.06.

Localization Experiments

CytoRP cDNA (SEQ ID NO: 233) was inserted into the pART7eYFP vector (Gleave, 1992). *Arabidopsis* mesophyll protoplasts were isolated and transformed with pART7CytoRPeYFP plasmids as described previously (Abel and Theologis, 1994).

Briefly, plant material was put in Plasmolysis solution containing 0.4 M mannitol, 3% sucrose and 8 mM $CaCl_2$ and incubated 30 min at room temperature (RT). Cells were spun at 42 g for 10 min at RT, resuspended in Enzyme solution containing 1% (w/v) cellulase and 0.25% (w/v) macerozyme diluted in Plasmolysis solution and incubated in the dark at RT for 1 h and for a further 1 to 2 h on an orbital shaker at 20 rpm. The obtained protoplasts were filtered through a nylon sieve (100 μm), washed by adding 30 ml of 0.4 M mannitol in W5 solution (5 mM glucose, 154 mM NaCl, 125 mM $CaCl_2$, 5 mM KCl and 1.5 mM MES pH 5.6) and spun at 42 g for 10 mM at RT. Protoplasts were then washed twice by adding 10 ml of mannitol/Mg solution (0.4 M mannitol, 0.1% MES and 15 mM $MgCl_2$) and finally re-suspended in 10 ml of mannitol/Mg solution.

To transform protoplasts, 50 μg of plasmid DNA were mixed to 250 μg of herring sperm carrier DNA, cleaned by three cycles of phenol/chloroform extractions and ethanol precipitations, re-suspended in 50 μl of $H_2O$ and mixed with 25 μl of chloroform. This solution was deposited in droplets on a petri dish next to 300 μl of protoplast solution ($2.10^6$ protoplasts) and 350 μl of PEG. The protoplasts were mixed to the DNA by gentle swirls to the plate. The PEG was injected at once by fusing the drop of DNA/protoplasts to the drop of PEG. Protoplasts were then diluted with 600 μl, 1 ml, 2 ml and 4 ml of 0.4 M mannitol in W5 solution added in droplets every 3 min. The diluted protoplasts were harvested by spinning at 20 g for 5 min at RT. Transformed protoplasts were re-suspended in 2 ml of culture medium (0.4 M sucrose, 1× Murashige and Skoog basal media and 250 mg/l xylose) and cultivated in the dark at 20° C. for 48 h.

Transformed protoplasts were visualised by confocal microscopy. eYFP fluorescence was observed by confocal laser scanning microscopy using a Zeiss LSM510 based on an Axiovert 200M microscope (Zeiss).

*Arabidopsis* Stable Transformation

A PCR amplified DNA fragment (SEQ ID NO: 234) containing CytoRP cDNA sequence (SEQ ID NO: 233) as well as AtPRORP2 promoter (SEQ ID NO: 231) and terminator (SEQ ID NO: 232) sequences was cloned in the binary vector pGWB13 (Nakagawa et al., 2007). The construct obtained was used to transform *Arabidopsis thaliana* ecotype col0 plants by the "floral dip" method (Clough and Bent, 1998).

Briefly, the pGWB13 construct, carrying the CyoRP insert as well as a hygromycin resistance marker gene, was transformed in *Agrobacterium tumefaciens* strain GV3101 cells. Bacteria were grown at 28° C. in liquid LB medium until $OD_{600}$=0.8, centrifuged and resuspended in 5% Sucrose and 0.05% Silwet L-77 solution. Aerial parts of *Arabidopsis* plants were dipped 3 times in the Agobacterium solution for 3 seconds with gentle agitation. Dipped plants were then placed under cover for 24 hours to maintain high humidity and grown according to standard conditions. Dry seeds were harvested and next generation individual plants analysed to test for their resistance to hygromycin and thus to identify individual transformants.

RNase P Activity Assays

Production of Recombinant PRORP Enzymes

PRORP cDNAs were cloned in pET28-b(+) (Novagen) to obtain C terminal fusions with histidine affinity tags. Proteins were expressed over night at 18° C. in BL21(DE3) *E. coli* cells induced with 1 mM IPTG. Bacteria were lysed and centrifuged 30 min at 30,000 rpm 4° C. The cleared bacterial lysates were incubated with the Ni NTA resin (Qiagen). The bound proteins were washed with buffers containing 50 mM imidazole, 20 mM MOPS pH 7.8, 150 mM NaCl and 15% (v/v) glycerol and 75 mM imidazole, 20 mM MOPS pH 7.8, 250 mM NaCl and 15% (v/v) glycerol. Proteins were eluted from the column using 200 mM imidazole and 500 mM imidazole buffers.

Production of Transcripts Representing tRNA Like Structures cDNAs representing TLS containing RNAs were amplified by PCR using 5' oligonucleotides containing T7 promoter sequences. PCR products were cloned in pUC19.

200 ng of linearized plasmid DNA were transcribed in a volume of 10 μl containing 7.5 mM rNTP, 5 U T7 RNA polymerase and buffer as supplied by the manufacturer (RiboMAX, Promega) for 4 h at 37° C. After this, plasmid DNA was digested with 1 U of RQ1 DNase for 15 min at 37° C. and synthesized RNA were purified by phenol chloroform extractions. Transcripts were dephosphorylated with 1 U FastAP Alkaline Phosphatase (Fermentas) for 30 min at 37° C. and 5' radiolabelled with $^{32}P$-γATP and polynucleotide kinase (Fermentas).

Cleavage Assays

Reactions were performed essentially as described previously (Gobert et al., 2010) with proteins purified as described (Gobert et al., 2010). Reactions were performed in 10 μl with 100 ng proteins and 100 ng 5' radiolabelled RNA, in buffer containing 20 mM Tris-HCl pH 8, 30 mM KCl, 4.5 mM $MgCl_2$, 20 μg/ml BSA and 2 mM DTT, for 15 min at room temperature. RNA molecules were separated on 8% polyacrylamide urea gels and visualized by ethidium bromide staining and/or by autoradiography.

Validation of the Antiviral Strategy

The degree of resistance of transgenic plants expressing CytoRP to model viruses containing a TLS is determined. For this, transgenic plants expressing CytoRP as well as control wild-type plants are infected with preparations of TLS (RNA) viruses. After infection, a comparative quantitative analysis of viral titer is performed over time. Viral titer is followed by immuno-detection using antibodies specific for viral proteins.

2. Results

To determine the localization of CytoRP in vivo, its cDNA was cloned into the vector pART7eYFP, thus inducing the fusion of CytoRP with the fluorescent protein eYFP (Gleave, 1992). Protoplasts of *Arabidopsis* cells were transformed transiently with the construct expressing the CytoRP-eYFP fusion. eYFP fluorescence was visualized by confocal laser scanning microscopy using a Zeiss LSM510 microscope. This revealed that the CytoRP protein is indeed localized in vivo in the cytosol of *Arabidopsis* cells (FIG. 3 and FIG. 4).

As a second step, it was built plants with CytoRP stably encoded in the genome. For this, a DNA fragment was generated where the CytoRP cDNA is inserted between the promoter sequence of AtPRORP2 in vivo (positions −1000 to −1 upstream of the native of AtPRORP2 initiation codon) and the terminator sequence of AtPRORP2 in vivo (positions +1 to +118 downstream of the AtPRORP2 termination codon). Promoter and terminator sequences were amplified from *Arabidopsis thaliana* genomic DNA. The resulting fragment was cloned in the binary vector pGWB13 (Nakagawa et al., 2007). The construct obtained was used to transform *Arabidopsis thaliana* ecotype col0 plants by the "floral dip" method (Clough and Bent, 1998). Transformed plants coding for CytoRP were identified by PCR using total genomic DNA from transformed plants extracts (FIG. 5). The selected plants thus contain all the PRORP genes encoded by the nuclear genome as well as CytoRP, expressed at the same level as AtPRORP2 and located in the cytosol.

Despite the removal of the NLS domain from AtPRORP2, CytoRP retains all the elements necessary for RNase P activity, especially the PPR domain responsible for RNA substrates binding and the NYN domain responsible for the catalytic activity of PRORP.

Transgenic *Arabidopsis* plants expressing CytoRP, a protein localized in the cytosol and holding RNase P activity, were constructed. This activity leads to the cleavage of tRNA-like structures (TLS) of plant viruses and thus generates plant resistance to TLS containing viruses.

RNase P activity assays of *Arabidopsis* CytoRP on in vitro synthesized transcripts representing tRNA like structures of plant viruses were carried out. Transcripts representing the 3' termini of TYMV, TMV and BMV genomic RNA tRNA like structures (TLS) were generated by T7 transcription in vitro and put in presence of *Arabidopsis* CytoRP proteins to test for RNase activity. The results are shown in FIG. 6.

EXAMPLE II

Amplification and Cloning of Cytorp Cdna Sequences of Representative Species of Agronomical Interest The CytoRP sequences from various agronomic relevant plants were amplified using the primers containing the restriction site NcoI (CCATGG) and XhoI (CTCGAG) for digestion and ligation in the plasmid pET28b. These sequences and primers were as follow:

Tobacco

*Nicotiana tabacum* CytoRP based on NtPRORP1 cv Samsun NN, genome "T" (mts deleted): SEQ ID NO: 240.

Primer forward: SEQ ID NO: 241
Primer reverse: SEQ ID NO: 242

The deleted part of NtPRORP1 (genome T) gene is presented in SEQ ID NO: 243. Only the 5' (N-terminus) of the gene (protein) is presented in SEQ ID NO: 243. The 3' (C-terminus) was not changed except the removal of the stop codon to fuse the gene with a 6×His tag.

Cucumber

*Cucumis sativus* CytoRP based on CsPRORP3 (N-terminus nls deleted): SEQ ID NO: 245.

Primer forward: SEQ ID NO: 246
Primer reverse: SEQ ID NO: 247

The deleted part of CsPRORP3 gene is presented in SEQ ID NO: 248. Only the 5' (N-terminus) of the gene (protein) is presented in SEQ ID NO: 248. The start codon was followed by ggc for glycine in order to accommodate the NcoI restriction site. The 3' (C-terminus) was not changed except the removal of the stop codon to fuse the gene with a 6×His tag.

Tomato

*Solanum lycopersicum* CytoRP based on S1PRORP3 (N-terminus nls deleted): SEQ ID NO: 250

Primer forward: SEQ ID NO: 251
Primer reverse: SEQ ID NO: 252

The deleted part of S1PRORP3 gene is presented in SEQ ID NO: 253. Only the 5' (N-terminus) of the gene (protein) is presented in SEQ ID NO: 253. The 3' (C-terminus) was not changed except the removal of the stop codon to fuse the gene with a 6×His tag.

Lettuce

*Lactica sativa* CytoRP based on LsPRORP3 (N- & C-termini nls deleted): SEQ ID NO: 255

Primer forward: SEQ ID NO: 256
Primer reverse: SEQ ID NO: 257

The deleted parts of the LsPRORP3 gene are presented in SEQ ID NO: 258 (N-terminus) and SEQ ID NO 260 (C-terminus). Only the 5' (N-terminus) and 3' (C-terminus) of the gene (protein) are presented SEQ ID NO: 258 and SEQ ID NO 260 respectively. The remaining part of the gene (protein) was not changed.

Onion

*Allium cepa* CytoRP based on AcPRORP3 (C-terminus nls deleted): SEQ ID NO: 262.

Primer forward: SEQ ID NO: 263
Primer reverse: SEQ ID NO: 264

The deleted part of AcPRORP3 gene is presented in SEQ ID NO: 265. Only the 3' (C-terminus) of the gene (protein) is presented in SEQ ID NO: 265. The 5' (N-terminus) was not changed except the addition of a gcg codon for alanine directly after the start codon of the gene contained in the NcoI restriction site.

EXAMPLE III

Total Rna Extraction From Plants, Dnase Treatment and Reverse Transcription

TRIzol® RNA Isolation Reagents (LifeTechnology) was used to extract RNA from plant samples.

Plants material was leaves from each plant.

Mortar and pestle were frozen using liquid nitrogen.

Leaf material (about 3 g) was ground to powder in liquid nitrogen.

Then, TRIzol (3 to 4 ml) was added to the powder. The powder was mixed with the TRIzol by inverting the tube and left 5 minutes on the bench at room temperature. Aliquotes of 1 ml were transferred in 2 ml tubes and 0.2 ml chloroform was added and the tubes were put on vortex thoroughly for 1 min. Then, the tubes were left 5 minutes on the bench at room temperature and centrifuged full speed for 10 min at 4° C. The supernatant (600 µl) was transferred in a new RNase free tube. 300 µl isopropanol was added, the tube inverted few times and then left 15 minutes on the bench at room temperature. The tubes were centrifuged full speed for 15 min at 4° C. The supernatant was removed, the pellet was washed with 1 ml 75% cold ethanol. The supernatant was removed, the pellet dried and resuspended in 20 µl RNase free mQ water.

Total RNA concentration was determined using the nanodrop 2000 (Thermo Scientific).

15 µg or 10 µg of total RNA was used for DNase I treatment in order to get rid of residual genomic DNA contamination. 10 µl DNase I buffer+MgCl2 10× and 10 µl DNase I (1 unit/µl) (Thermo Scientific) were added in a total volume of 100 µl.

The tubes were incubated 30 min at 37° C.

A RNA phenol/chloroform extraction was then operated. 100 µl phenol/chloroform was added to the reaction and vortex thoroughly for 20 sec. The tubes were centrifuge full speed at room temperature for 5 min.

The aqueous supernatant was transferred into a new RNase free tube and the RNA was precipitated with ethanol (10 µl 3 M Na Acetate pH5.3 and 250 µl absolute ethanol).

The tubes were left 1 hour at −20° C. and then centrifuged full speed for 30 minutes at 4° C.

The supernatant was removed, and 1 ml 75% ethanol was added to wash the pellet.

The tubes were centrifuged full speed for 5 minutes at 4° C. and the supernatant removed.

The pellet was dried and re-suspended in 10 µl RNase free mQ water.

3 to 5 µg of total RNA were used for the first strand cDNA synthesis.

Maxima Reverse Transcriptase (Thermo Scientific) at 200 U/µl supplied with 5×RT buffer were used.

A mix of oligo(dT)$_{18}$ and random primer was used for the first strand cDNA synthesis.

The reactions were performed with the provider specifications.

Typical first strand cDNA synthesis is as follow:

|  | 1 reaction |
| --- | --- |
| RNA treated DNase I (5 µg) | 5 µl |
| Oligo(dT)$_{18}$ (100 µM) | 0.5 µl |
| Random Primers (0.2 µg/µl) | 0.5 µl |
| dNTP | 1 µl |
| H2O | 7.5 µl |

The PCR tube containing the mix is incubated at 65° C. for 5 min then put on ice for 2 min.

After a short spin in a bench-top centrifuge, the following mix is added in the tube:

| Buffer Maxima RT 5x | 4 µl |
| --- | --- |
| RNase OUT 40 U/µl (Invitrogen) | 0.5 µl |
| Maxima RT enzyme | 1 µl |

The PCR tube containing the mix is centrifuged shortly and incubated 10 min at 25° C., 45 min at 50° C. and the enzyme is inactivated at 85° C. for 5 min.

The cDNA is then ready for use in PCR reaction.

1 to 2 µl cDNA produced were used to amplify PRORP coding sequences with the primers listed below:

Primers were designed and ordered at Integrated DNA Technologies (IDT) to amplify cDNA of PRORP from tobacco *Nicotiana tabacum* (Nt), cucumber *Cucumis sativus* (Cs), lettuce *Lactuca sativa* (Ls), tomato *Solanum lycopersicum* (Sl) and onion *Allium cepa* (Ac).

| NtP1F | gtcattcatatccccagcaatg | SEQ ID NO: 267 |
| --- | --- | --- |
| NtP1R | ccctcggagtcgatcaatttat | SEQ ID NO: 268 |
| CsP3F | ctacagatacttctggaatggattc | SEQ ID NO: 269 |
| CsP3R | ggactcggccacatagcta | SEQ ID NO: 270 |
| LsP3F | gcaaggagaacttactcaacaatg | SEQ ID NO: 271 |
| LsP3R | tgtgacaaaaaacccaagtttcta | SEQ ID NO: 272 |
| SlP3F | gccattactaccggaaaatg | SEQ ID NO: 273 |
| SlP3R | gttctggaaaaggtatcaccttc | SEQ ID NO: 274 |
| AcP3F | ctcagtcgacccagaaaagtatg | SEQ ID NO: 275 |
| AcP3R | caaaactaacgaccacaaaaatgcta | SEQ ID NO: 276 |

Typical PCR mix is as follow:

Components for 1 PCR reaction (µl)

| 2x Phusion MasterMix (Thermo Fisher Scientific) | 25 |
| --- | --- |
| Forward primer | 2.5 |
| Reverse primer | 2.5 |
| cDNA | 1 |
| mQ H2O | 19 |
| Total volume | 50 |

Typical PCR cycling is as follow:

| Initial denaturation | 98° C. | 30 sec |
| --- | --- | --- |
| Denaturation | 98° C. | 10 sec |
| Hybridization | 60° C. | 10 sec |
| Elongation | 72° C. | 1 min 30 sec |
| Final elongation | 72° C. | 5 min |

35 cycles of denaturation, hybridization and elongation were done

A PCR sample of 2 µl (from the 50 µl) was mixed with water (3 µl) and 6×DNA loading dye (1 µl) and charged into a 1 agarose gel. 4.5 µl MassRuler (Thermo Scientific) was used for size determination. Results are shown in FIG. 7.

The DNA from the remaining of the PCR was extracted (kit Macherey-Nagel referred as MN hereafter Nucleospin Gel and PCR cleanup).

The standard protocol of the kit was used and elution was made with 15 µl NE (Tris-HCl pH8,5).

The purified DNA was quantified with nanodrop 2000.

The Phusion polymerase producing blunt ends, a A-tailing procedure was done using the protocol of "pGEM-T and pGEM-T Easy vector systems" manual (Promega).

Typical A-tailing procedure is as follow (in 0.2 ml PCR tubes):

Components for 1 reaction (µl):

| | |
|---|---|
| H2O mQ | 2.8 |
| Tampon Taq 10x with MgCl2 | 1 |
| dATP (10 mM) | 0.2 |
| Cleaned up DNA from PCR | 5 |
| GoTaq2 (Promega) | 1 |
| Total (µl) | 10 |

Incubation at 70°C. for 20 min in thermocycler.

The A-tailed product is ligated into the pGEM-T easy vector following the procedure described in the manual of "pGEM-T and pGEM-T Easy vector systems".

Typical ligation procedure is as follow (in 0.5 ml tubes):
Component for 1 ligation (µl):

| | |
|---|---|
| 2x rapid ligase buffer | 2.5 |
| pGEM-T easy vector | 0.5 |
| A-tailed DNA from PCR | 1.5 |
| T4 DNA ligase | 0.5 |
| Total (µl | 5 |

The tubes were incubated for 3 hours or overnight at room temperature.

The ligation mix was used for *E. coli* TOP10 chemo-competent cells transformation.

Typical transformation procedure is as follow (in 0.5 ml tubes):

−80° C. conserved *E. coli* TOP10 chemo-competent cells were thawed on ice for 15 min.

2.5 µl of ligation mix is added to the cells in ice and left for 30 min in ice. Heat shock at 42° C. was performed for 45 sec (water bath).

The tubes were then cool down 2 min in ice.

600 µl sterile LB solution was added to the cell transferred into a 13 ml round bottom tube.

The tubes are incubated at 37° C. on a shaker for 1 hour.

200 µl cells are plated on Petri dish containing 25 ml LB agar supplemented with ampicillin and X-gal (in flow hood).

After drying, the plates are incubated at 37° C. for the night.

The next morning, plates are placed in the fridge to increase the blue-white screening of the colonies.

The white colonies (containing an insertion in the LacZ gene) are used for a PCR screening.

Typical PCR reaction is as follow:
Components for 1 reaction (µl)

| | |
|---|---|
| H2O mQ | 13.4 |
| Tampon GoTaq 5x with LD (Promega) | 4 |
| MgCl2 (25 mM) (Promega) | 1.2 |
| dNTPs (10 mM) | 0.4 |
| M13 FW (10 uM) | 0.4 |
| M13 RV (10 uM) | 0.4 |
| GoTaq 2 enzyme (Promega) | 0.2 |
| Bacteria from a single colony | bacteria |
| Total volume | 20 |

Master mixes were prepared to screen for 8 to 16 colonies
Typical PCR cycling is as follow:

| | | |
|---|---|---|
| Initial denaturation | 95° C. | 3 min |
| Denaturation | 95° C. | 30 sec |
| Hybridization | 47° C. | 30 sec |
| Elongation | 72° C. | 2 min 30 sec |
| Final elongation | 72° C. | 5 min |

35 cycles of denaturation, hybridization and elongation were done 1% agarose gel is prepared and 5 µl PCR product was loaded. 4.5 µl Mass-Ruler was added for size determination. Results are shown in FIG. 8.

Plasmid preparations were performed with 3 ml LB ampicillin cultures inoculated with colonies containing CytoRP (overnight cultures). Kit MN, Nucleospin Plasmid QuickPure (Elutions with 30 µl NE).

The concentration of these samples was determined with Nanodrop 2000.

Sequence analysis revealed that no single nucleotide polymorphism for the various sequences that could alter the production of the CytoRP is present. Then, the positive plasmids were diluted to 5 ng/µl and were used as PCR templates for the production of the respective CytoRP. For *N. tabacum* only a PRORP1 clone was used to produce a CytoRP (not PRORP3).

The primers presented in Example II were used to amplify the CytoRP genes in order to clone them in pET28b expression plasmid.

Typical PCR mix is as follow:
Components for 1 PCR reaction (µl)

| | |
|---|---|
| 2x Phusion MasterMix (Thermo Fisher Scientific) | 25 |
| Forward primer | 2.5 |
| Reverse primer | 2.5 |
| Plasmid (5 ng/µl) | 1 |
| mQ H2O | 19 |
| Total volume | 50 |

Typical PCR cycling is as follow:

| | | |
|---|---|---|
| Initial denturation | 98° C. | 30 sec |
| Denaturation | 98° C. | 10 sec |
| Hybridization | 60° C. | 10 sec |
| Elongation | 72° C. | 1 min 30 sec |
| Final elongation | 72° C. | 5 min |

35 cycles of denaturation, hybridization and elongation were done.

REFERENCES

Abel and Theologis (1994) Plant J 5, 421-427.
Altman, S. (2007). Mol Biosyst 3, 604-607.
Altschul, S. F., et al., (1990). J Mol Biol 215, 403-410.
Barkan, A., et al., (2012). PLoS Genet 8, e1002910.
Borghi, L. (2010). Methods Mol Biol 655, 65-75.
Clough, S. J., and Bent, A. F. (1998). Plant J 16, 735-743.
Crooks, G. E., et al., (2004). Genome Res 14, 1188-1190.
Dreher, T. W. (2009). Virus Res 139, 217-229.
Dreher, T. W. (2010). Wiley Interdiscip Rev RNA 1, 402-414.
Emanuelsson, O., (2000). J Mol Biol 300, 1005-1016.
Edgar, R. C. (2004). BMC Bioinformatics 5, 113.

FAO, WFP and IFAD. (2012). The state of food insecurity in the world 2012. Economic growth is necessary but not sufficient to accelerate reduction of hunger and malnutrition. Rome, FAO.
Gleave, A. P. (1992). Plant Mol Biol 20, 1203-1207.
Gobert, A., et al., (2010). Nature struct & molec biology 17, 740-744.
Gobert, A., et al., (2013). Nat Commun 4, 1353.
Guerrier-Takada, C., et al., (1988). Cell 53, 267-272.
Gutmann, B., et al., (2012). Genes Dev 26, 1022-1027.
Howard, M. J., et al., (2012). Proc Natl Acad Sci USA 109, 16149-16154.
Jopcik M., et al., (2013). Plant Cell, Tissue and Organ Culture (PCTOC) 113, 387-396.
Karpenahalli, M. R., et al., (2007). BMC Bioinformatics 8, 2.
Kelley, L. A., and Sternberg, M. J. E. (2009). Nature Protocols 4, 363-371.
Lurin, C., et al., (2004). Plant Cell 16, 2089-2103.
Nakagawa, T., et al., (2007). J Biosci Bioeng 104, 34-41.
Needleman, S. B., and Wunsch C. D. (1970). J Mol Biol, 48, 443-453.
Nguyen Ba, A. N. (2009). BMC Bioinformatics 10, 202.
Perez-Bercoff, A., et al. (2006) Bioinformatics 22, 112-114.
Shahmuradov, I. A., (2003). Nucleic Acids Res 31, 114-117.
Small, I. D., and Peeters, N. (2000). Trends Biochem Sci 25, 46-47.
Small, I., (2004). Proteomics 4, 1581-1590.
Yoshida, K., and Shinmyo, A. (2000). J Biosci Bioeng, 90, 353-362.

SEQUENCE LISTING (276 sequences)

SEQ ID NO: 1 - protein, 8 aa, Artificial Sequence
  NYN domain
  VARIANT (1)..(1): /replace = Glu, Thr, His, Asn, Pro or Gly
  VARIANT (2)..(4): hydrophobic amino acids with few exceptions where 1 out of 3 amino acids is nucleophylic
  VARIANT (6)..(6): /replace = Ala
  misc_feature (7)..(7): Xaa can be any naturally occurring amino acid
DAIVDGXN

SEQ ID NO: 2 - protein, 25 aa, Artificial Sequence
  NYN domain
  misc_feature (3)..(17): Xaa can be any naturally occurring amino acid
  VARIANT (18)..(18): /replace = Thr
  misc_feature (19)..(19): Xaa can be any naturally occurring amino acid
  misc_feature (21)..(23): Xaa can be any naturally occurring amino acid
DDXXXXXXXXXXXXXXXSXDXXXDH

SEQ ID NO: 3 - protein, 4 aa, Artificial Sequence
  Zinc-binding module
  misc_feature (2)..(3): Xaa can be any naturally occurring amino acid
CXXC

SEQ ID NO: 4 - protein, 5 aa, Artificial Sequence
  Zinc-binding module
  VARIANT (1)..(1): /replace = Tyr or Phe
  misc_feature (3)..(3): Xaa can be any naturally occurring amino acid
  misc_feature (5)..(5): Xaa can be any naturally occurring amino acid
WHXPX

SEQ ID NO: 5 - protein, 7 aa, Artificial Sequence
  Zinc-binding module
  VARIANT (1)..(1): /replace = Phe
  misc_feature (2)..(2): Xaa can be any naturally occurring amino acid
  MISC_FEATURE (4)..(6): one of the thrree residues may be deleted
  VARIANT (7)..(7): /replace = Lys
WXCXXXR

SEQ ID NO: 6 - protein, 6 aa, Artificial Sequence
  Peptide motif
  misc_feature (3)..(3): Xaa can be any naturally occurring amino acid
  VARIANT (5)..(5): /replace = Phe or Cys
  VARIANT (6)..(6): /replace = Thr
MPXPYS

SEQ ID NO: 7 - protein, 1040 aa, Artificial Sequence
  PRORP consensus amino acid sequence
  MISC_FEATURE (1)..(700): some of the Xaa residues may be deleted
  misc_feature (701)..(702): Xaa can be any naturally occurring amino acid
  misc_feature (733)..(736): Xaa can be any naturally occurring amino acid
  misc_feature (741)..(741): Xaa can be any naturally occurring amino acid
  misc_feature (832)..(832): Xaa can be any naturally occurring amino acid
  misc_feature (845)..(845): Xaa can be any naturally occurring amino acid
  misc_feature (853)..(854): Xaa can be any naturally occurring amino acid
  misc_feature (856)..(856): Xaa can be any naturally occurring amino acid
  misc_feature (881)..(881): Xaa can be any naturally occurring amino acid
  misc_feature (885)..(886): Xaa can be any naturally occurring amino acid
  misc_feature (888)..(888): Xaa can be any naturally occurring amino acid
  misc_feature (891)..(897): Xaa can be any naturally occurring amino acid
  misc_feature (901)..(902): Xaa can be any naturally occurring amino acid
  misc_feature (916)..(1040): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXXXGESPSSKKKKKKXXXXXXXXKRESPEGVLRVKLDMCSSKRGDLVGALRLYDXEARSXXNGXXXXIRLSQHHYNVLLYLCSSAASXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDESLKNLAXXLQRGFEIFXEQMVSDGXXVPPNEATFTSVARLAAAXXXXKGDGXXXXXDMAFDLVKQMXKSYGIPXPRLRSYGPALFGFCXXKKGEADKAYEVEAHMLESGVVPEEPELAALLKVXXSVEAGRADKVYEYLHKLRTSVRQVSESTAKVIEDWFKXSEKASEVXXGKEXKWDXXXXVGKVREAVVNGGGGWHGQGWLXGKGKWTVKRTNVDXEDGVCKSCGEKLVCIDIDPVETENFAESVASLACEREVKANXXXXXXXFSEFQEWLEKHGPFEAVVDGANVGLYQQNFXXXXFSFSXQLNAVVNELRQRSPSKKWPLIILHNKRVTGGPAENPSNRKLIEKWKNAGALYATPTGSNDDWYWLYAAVKCKCLLVTNDEMRDHLFQLLGXNSFFPRWKERHQXVRYTFSKXXGXLKLHMPPPYSVVIQESEKGSWHVPXIATXXEXDDXXXXXXXLESXXPRTWLCITRASSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 8 - protein, 568 aa, Oryza sativa
MAKSLHWEVRKSYSQDNEAAAIRPTAALLLLFPPHRRTTSLRRSSLPFARPRRHSTTTTTAESHPKPNESNAARRRPRPRLAPEGLLKAKLDMCSRDNDLPTALALYEAAISPDSLIPLSLGHYNCLLYLCANAAAADSSSPDAAQRGFDIFSRMEADGVQPNEATLTILARLAAARRDPAMAFSIVRRMATAGTAPHLRSYGPALFAYCDAGDADGATEVEAHMDASGVVPEEAELAALLRVNSARGRPDQVYRLLHRARVLLRQVADATAQLLESWFASHAASEAGLDHWDATKVKQGLRNGGGGWHGQGWLGKGQWTVARTDMDKDGTCHRCGEKLVCIDIDPSETHSFAESVAQIAINRDANFVKFQKWLECHGPFDAVIDAANVGLYNRNSFSFYEVNRVVNGIQRITKSKKLPLIILHKNRVNGGPAKLPQNQKLLESWQRAGALYATPPGSNDDWYWLYAAVIYRSLLVTNDEMRDHLFQLLGTSFFPRWKENHQVRLTFSGRGWNFHLPPPYSIVIQESEDGSWHVPTTNGDDIEKPRQWICATRKISGKSSQALARAVG

SEQ ID NO: 9 - protein, 719 aa, Oryza sativa
MAMAPLFVPPPHLLFLLPATTSSSPAASLRRLLLPPLSCHARQVLDVMPQGDRVAGPRAAEGAGAKGATAQVGVATREAGTAGRHGRGRHGGGARPWRRGEDRPARGGQHAADDGEVQGTRRGGDLKQRREGRRWTRGETQARESGKAGNSGRCQSNGSGGNASRKGKKKAKGGENEVKLRVELDMCSKRGDVIGAINLYDSAVKEGIKMGQHHYSVLLYLCSSAALGFVQPAKSGNAGSGIASIGQLHSSSTQSVGNLEGDDVQSEGHSEDQEGNKTDLFASDDGTEKPSRIPVSDELREYARTRGFEIFEKMRSEEEKVPMNESALTAVARMAMSMGNGDMAFDVVKQMKDQGIAPKLRSYGPALTAFCNSGNVEKAFEVEAHMLESGVRPEEPELETLLKASVAAQQGDKVYYLLHKFRTTVRQASSTTAKLLEDWFQSPTASKVGKRKWDSGAITKAIENNGGGWHGLGWLGRGKWTISHSHIDRNGACLACGEKLTIIDLDPKETEDFATLVAKLAIKRERRSNFDNFQKWLEKHGPFDAVVDGANVGLFSHKHISLSKINIVADVIRQRFQSRKLPLIVVHNRHLTGERMQKPSNRKLVEKWKLSNAIYATPTGSNDDWYWLYAAIRCKCLMVTNDEMRDHTFQLLERDFFPKWKERHQVRFNFEDSCVTLQMPPPCSVVIQESENGQWHIPVVSEEGSLEKDRTWLCVTRRN

SEQ ID NO: 10 - protein, 548 aa, Oryza sativa
MATAAGASSPARRRPRRGSKGPNSDLSRTLTDCTRRGDAAAAMAAFDSALSGPDAPRLLAHQYNQLFHLLATADADSLPNAAAAARRVFSHMLGSGASPSEATITSLARVTASDASNPAAADEAFDLVATMRDKYGVAPRLRSYSPVLAAFRRAGEAGKAYAVDAHMEASAVAPEEPEIAALLDVSAKAGDADKVYEYMHKLSRTVDCVGEETAEVLEGWFRSGKAAMAGKAEWDACKVKDAIVANGGGCHRLGWLGTGPWTVQRVRVGGDGQCEGCGCRLACVDIDVEETQRFADSVASLALQRETKINFSQFQEWLEEHGAYEAIVDGANIALYQQNFAEGGFSLTQLDAVVTELRDRYNGKWPLVVLHNKRIAKLMENASNRHLIETWRANGALYTSPIGSNDDWYWLYAAIRLNCLLVTNDEMRDHIFELLGSSFFPKWKQRHQVKYTFSKGKAVLMMPPPYSSEIQESEMGSWHVPMEEKSGDDRARIWLCIDRTGHCKHPHEAPAANGVVQDVSPTEASHGCEQRRAEHNGGSLTGKRKDRN

SEQ ID NO: 11 - protein, 553 aa, Zea mays
MRAAMAAAVLRPTAATLRFLSTPPHQRRRVLVGHLPFARRRRHSSTATAPALEDSSPRSGEGKAVRRRRARESPQGLLRHQLDMCSRNADLTTALRLYDDALSPDNPIPLSLHHYNCLLYLCSNAAATDSDSHISATAAQRGFDIFARMEADGVQPNEATLTSVARLAAATRDPAMAFSVVRRMAAAGTPPRLRTYGPALFAYCDAKDADGAKQVEAHMDASGVVPEEPELAALLRVNADTGKADEVYRLLHRTRVLVRQVCDTTAQVVEAWFRSDAASQAGVDSWDPTKVKEGVVKGGGGWHGQGWLGKGAWSVGWTEMGKDGTCQRCGERLVCIDIDPAETDNFANSLTELAIKLEAREDFLSFQSWLRRHGPFDAVIDAANVGLYKSKDFCFSQVNSVVNAIQRVTKSKKLPLIVLHRSRVNVGPAKAPYNQKILDSWRNAGALYATPPGSNDDWYWLYAAVSCRSLLVTNDEMRDHLFQLLGTSFFPRWKEKHQVRLTFSGHGPTLHLPPPYSIVIQESEDGSWHVPTTTGDDIEKPRQWLCTTRKSLR

SEQ ID NO: 12 - protein, 684 aa, Zea mays
MPYRDSRPSGTEGSRAGPGGAPRVTNSSTVRGNATAQEAHMPMWRERTPGTPRTWKKGDRVMLQEHAEGESQEKSWRRGLTRSLESKGPMVRKSWTRDGNGMRAKESGKVGNSRDEGTGRRNACKKMKKPPDGEYAGKLRVELDMCSKRGDVMGAITLYDSAVEEGIKLGQHHYNVLLYLCSSASLGFVQPAKSGNMGSGIASIGPAQKLDPSPSRSLGGSEGDNAYASESHVQDQGKNKADLIPGGLKAQTVSIPVEDELGDYARARGFEIFDKMCSEKERVQMSEAALTAKARMALSMGDSDMAFEIVKQMKGLGLKPKLRSYGPALTAFCNSGNVEKAFEVEAHMLESGITPEEAELETLLRASVVGRRGDKVYYLLHKFRTAVRQVSHSTAELFEAWFRSPTASKVGKRKWDAGAIAKAIENNGGGWHGFGWLGRGKWTVAHSNINENGVCLACGEKLAIIDLDPKETEDFATFVAKLAIKRERKSNFENFQKWLEKHGPFEAVVDAANVGLFSHKHLSLSKVNSVADAIRLRFTSKKWPLIVLHNKHLIGERMKKLNDHKLVQKWKQENSIYATPTGSNDDWYWLYAAIRCKCLIITNDEMRDHTFQILERNFFPKWKERHQVHFTLEDRCVTFQMPPPYSVVIQESDKGHWHIPVSEEGLLEKDRTWLCVTRQNSQAQ

SEQ ID NO: 13 - protein, 521 aa, Zea mays
MASTATTRRRPRRGSKGPNADLSRTLTDCTRLSAHQYNQLLHLLAATDRSSFPSPPAAAARRVFAHMLQAAAPPSEATITSLARVIAADPASAADEAFELVATMKDKYGLSPRLRSYGPVLAAFRRAGEAAKAYAVEAHMTASGVSPEEPELAALLDVSSRAGDADKVYEYMHKLRQAVHCVSEETAGVVEAWFRSDEAATAGKPQWDAAQVKDAIVANGGGCHRLGWLGTGPWTVQRVRVGDADQCGGCRFHLACIDIDMEETQRFADSVAGLALERETKTNFSRFQEWLEANKDYQAIVDGANIALYQQNFAEGGFSLTQLDGVITELRDRYHGKWPLVILHNKRISKLMENSSNRHLIETWRTNGALYTSPSGSNDDWYWLYAAIKLNCLLVTNDEMRDHIFELLGPSFFPKWKQRHRVKYTFNKGKAVLVMPPPYSSELQESEMGSWHIPIEEKSGNERGRIWLCIGRGGSCKEHGEVPSTNGAVHKVPQTEASNVVQQGLTENKDESITGKRKDRD

SEQ ID NO: 14 - protein, 749 aa, Triticum turgidum
MRLAAAAGVLRPTAALLFHSRPHRLLPSPRRSSLPFARRRRDSSSSSTATALDDPPPPSASSPPSPAPPAPTGEGGETKAARRRRARESPAGILRHRLGICSRDADLATALELYADAVDPATAVPLALHHYNCLLYLCSNAAAEDADAARRGFEIFAAMEAQGVEPNEATLTSLARLAAAVRDPAMAFSVVRRMAAAGIPPRLRSYGPALFAYCDARDAHGAAEVEAHMDAGGVVPEETELAALLRVNADTGRADQVYRVLHRTRTLVRQVCEATAQVVEAWFQSDAAAEAGVEKWDARKVREGVVKGGGGWHGQGWLGKGQWDVGQSEMDKNGKCQRCGEKLVCIDIDPSETETFAKSLAELACKREVRDDFVRFQDWLRRNGPFDAVIDAANVGLYNSKAFSFSQVNSVVNGIQRVTKSKKLPLIVLHRSRVNCGPAKAPQNQKLIESWRNAGALYSTPPGSNDDWYWLYAAVSCRSLLVTNDEMRDHLFQLLGTSFFPRWKEKHQVRLTYSGRGPTFHLPPPYSIVIQESETGSWHVPTTTGDDIESPRQWVCATRKTSEGPPSPPPQARVSSKTSERLPSPPPQACATRKTSERPPSPPPQARATRKTSEGPPSPPPQARATSKTSERLPSPQPQARATSKTSERPPSLQPQARATSKTSERPPSPPPQARSTRKTSERPPSPPPQAHGTRKTSERPSSPPSQASATSKTTEGPSSPPSQASATIKTSEGPSSPPPQARLSDLGW

SEQ ID NO: 15 - protein, 552 aa, Triticum turgidum
MASAAAAAGDGTRRKRGLGGKGPNSDLSRTLTDCTRRGDAAAAMAAFDAALSGPDAAPGLRLAAHQYNQLLHLLASADRAAFPARPAAAARRVFAHMLGAGAPPSEATITSLARVVAADDAEGADEAFGLVSTMREKYGLAPRLRSYSPVLAAFRRAGEAGKAYEVEAHMAASAVSPEEPEIAALLEVSAKAGDADKVYEYMHKLRRAVGCVKEETAEVLEGWFESEKAAAAGKAEWDVCQVKDAIVANGGGCHQLGWLRTGPWTVQRVRVGADGECSGCGCRLASVDINMEDTQKFADSISGLALERETKANFSQFQEWLEAHKEYEAIVDGANIALYQQNFAEGGFSLVQLDAVVTELRDRYSGKWPLVILHNKRIAKLMENSSNRHLIETWRANGALYTSPSGSNDDWYWLYAAIGLNCFLVTNDEMRDHIFELLGSSSFFYKWKQRHRVKYTFNKGKAVLVLPPPYSSEIQESETGSWHVPIEEKSGDERARTWLCIGRTDLSKPPREPPVANGVAQDLSPSEASNGAGQRQPEEQAAPVTGKRKDRD

SEQ ID NO: 16 - protein, 567 aa, Solanum lycopersicum
MLVRRMGYISPSLSIKTSPFFSILTKNPFPFHHLHPIQFFKPIHTKSPQTHLFSMNQKPHFTTSAAFLQEPTNTKTLSNRSAKKARRDAPESVLRHQLDQCSKRGDLQEAIRLYEEAKLNNITLNVHHYNVLLYLCSSGSGTEGCGIEKGFLIFKQMGVNGVAPNEATFTSAARLAVAKQDPEMAFDLVKKMKSFGVPPKLRSYGPALFGFCEKGMADKAYEVDVHMGESGVVAEEAELSALLKVSSFSKKADKVYEMMHRLRASVRQVCEETVGVVEDWFNSEYAAEVGLQDWDARKVKEGVVKGGGGWHGQGWLGKGNWTVVRAEMDSSGVCRSCGEKLVCIDIDPKETENFANSLAELASEREVKANFVQFQDWLQKHGPFDAVVDGANVGLITQRNFNFSQLRSVVNKLRQMSESKKLPLVILHKSRTTGGPAQHPNNKKLLESWKKAGALYATPHGSNDDWYWLYAAVSSKGLLLTNDEMRDHLFQLLGTSFFPRWKEKHQIRMTASRDDGLKLHMPPPYSIVIQESEQGCWHIPTLTGDDLEIPRQWVCATRKKALHSVFR

SEQ ID NO: 17 - protein, 768 aa, Solanum lycopersicum
MASIPFKPTTQFQLQLYSSTILLNPFKFHTSLPRISSSVHVTHVETQTTEQEISHTRRDGKTNSNENGSGFSSFTPKYKKSYSGQENGANRVVLKDRNAKLKPKRRSSTTTTSNNKAVESKKSKIDSTLRIGLDMCSKRGDVLSAIKLYDLALLQGIVMGQYHYAVLLYLCASAATGLIHPAKSGSVNRTLNAPNEQEFSLNDKVIEHDSHLLSSSTVDEFVQFMKSSAKSVRHDDNGIKVSEDVRHYALTRGFEIYEKMLSDKVQINEATLTSVARMAMALGNGDMAFDVVKKMKEDGINPKLRSYAPALSVFCNNGDVDKAFIVEQHMLENGIYPEELELEALLKVSIEAERSEKVYYLLHKLREGVRQVSPSTADLIDKWFNSKVASRVGKRKWDVRSIHKAIKNGGGGWHGQGWLGNGKWTVSHGIVGSDGCCKCCAEKLVTIDLDPEETEKFAKSVASIAAQRERNSSFQKFQRWLDYYGPFEAVIDGANVGLYSQRKFRPSKVNAVVNGIRQMLPSKKWPLIVLHNRRITGDKMDEPFNRSLVEKWKNADAIYATPTGSNDDWYWLYAAIKFRCLLVTNDEMRDHLFQLLGNDFFPKWKERHQVRFSFSETGPVFHMPPPCSIVIQESEEGNWHVPIASELESEEERTWLCIRRANSPMAHQDSSRVNISKNVGGPTHKCPPTSSDSPHNKGDAKSSTRRKNQVKVTGKTRGSHCRGKDAPEEMYRSLKNILQPSITSDHCSILPELKAAEELGRCVVDFQI

SEQ ID NO: 18 - protein, 552 aa, Solanum lycopersicum
MDKAKNKKKNLTPEGQFRSSLDNCSKTKDLSTAISLYESAISDASTIRLSSNHFNSFLYICSNSFSDPSTKNDAIQFGFRVFEHMDSCNITPNEATVTAVARLAAATDDGDRAFELAKGVGNCGKLRTYGPALFCFCKMGEADKAYQVEEHMRSLGLQLEEAELAGLLKVSVEKEREEKVYQYLHKLRMSIRSVSDSTAEIIQSWFGGEMATKVGLSNGDMDQVKEVILQNGGGWHGLGWLGKGKWLAQRSQIAPDGRCLSCGEQLVCVDIDRSETERFAESVASLAMEREVHSNFKEFQDWLEKHSDYDAVVDAANVGLFQQNFAAGGFSIAQFVAVVKELHSRSNKWPLVILHKKRVRTLLEDAGYRELLEEWINEKILYGTPFGSNDDWYWLYAAVKCKCLLVTNDEMRDHIFELLGSSFFARWKERHQVKYTFVKGEIKLLMPPTYSVVIQESENGSWHVPLAGEVVEESSRTWLCITRQASCESDNKQLASVVEASEVSEPDQIAACCHSDSFTSQNGGSLNKCSGLAGKRKERSPSPTPSHSSLQS

SEQ ID NO: 19 - protein, 573 aa, Brassica rapa
MLRATCFTPSLSRAYCPLFALFLRIPSVHHPHHPSSSPFRGYHSSLQVKGSRDRRRILVDHNRHLCTIPEAAKQPPASTSENLSRKARKKAIQQSPESMLKQKLDMCSRNGNVLEALRLYDEAKRNGLQLSQYHYNVLLYVCSLTDGEAESPSANPGLSRGFDIFKQMIVDKVVPNEATFTNGARLAVAKDDPEMAFDMVKQMKAFGIQPRLRSYGPALFGFCRKGDAEKAYEVDAHMIESEVVPEEPELTALLKVSMETKNAEKVYETLQRLRDLVRQVSKPTFDAIEEWFESEAAGKAGVEKWDVKRIREGVVSGGGGWHGQGWLGTGKWNVTRTEMDENGVCKCCKEKLVCIDINPVETENFAASLTRLACQKEVKASFNQFQEWLERHGPFDAVIDGANMGLVNQRSFSFFQLNNVVQRFQQISPSKRLPLVILHKSRVVGGPATYPKNRALLEKWKNAGALYATPPGSNDDWYWLYAAVSCKCLLVTNDEMRDHLFQLLGTSFFPRWKEKHQVRISVSREDGLKLHMPPPYSIIIQESEDGRWHVPMSVEDDLQTSRQWLCARRSKTH

SEQ ID NO: 20 - protein, 535 aa, Brassica rapa
MAANGQRRSRQDDESPSNPNKKRKANKNPEKNLLFNLNSCSKSKDLSAALALYDAAVASNEVRLNQQHFQTLLYLCSASISDPCLQTLAVERGYQIFDRMVTSGLTFNEATVTSVARLASAKGDGDYAFEIVKDFASVGGTSIPRLRTYAPALLCFCERLEAEKGYEVEEHMEAAGIALEEAEISALLKASAATSRENKVYRYLHKLRESVGCVCEETSKVIEDWFCGEKAGEVSSDGIGSDVEMLREAVLRNGGGWHGRGWVGEGKWIVKKDNVSSTGRCLSCNEQLACVDTNEVETQKFVDSLVALAMERKAKMISSETKVDFSEFQDWLEKHGDYEAIVDGANIGLYQQNFADGGFSLSQLEGVVNELYHKSGDKKWPLILLHKKRVRTLLENPTHRNLVDEWINNGVLYATPPGFNDDWYWLYAAAKLKCLLVTNDEMRDHIFELLSNSFFQKWKERHQVRYTFTKGNLKLEMPPPFSVVIQESEKGSWHVPVASQNNESSRTWMCISRRSVLDSLMINGKLETSENGDSS

SEQ ID NO: 21 - protein, 515 aa, Brassica rapa
MATSDHPRSRHHRDESPTKPNKKKKASHNQEKNLLVSLHSCSKSKNLSAALSLYDAAIASGDVRLSQQHFQSLLYLCSASLGDPSLQTLAIDRGFQVFERMVGSGISPNEASVTSMARLAAAKGDGDYAFKVVKDIVAVGGVSVPRLRTYAPALLCYCERLEAEKGYEVEEHMEASGIVLEEVEISALLKVSAATGRENKVYRYLHKLREYVGFVSEETSKVIEEWFCSEKASEVVRIGSDVELLRAAALKNGGGWHGLGWVGEGKWVVKKGNVSADGECLSCGEHLACVDTNEVETENFVNSLVALAVERKAKMNSSEPMEDFSEFQEWLEKHGDYEAILDGANIGLYQQNFADGGFSLPQLEAVVKELYSKSGNKKWPLILLHKKRVNALLENPNHRNVVEEWISNDVLYTTPPGSNDDWYWLYAAAKFKCLLVTNDEMRDHIFELLSTSFFQKWKLRHQVRYTFVKGSLKLEMPPPFSVVIQESEKGSWHVPITCKDGEESLRNWMCVTRQS

SEQ ID NO: 22 - protein, 551 aa, Carica papaya
MFKFPLQLFPRNSRRLFLRHSYRSSVASSATWVHRFPMDGRAHLCTAAIAAKKFAVPASDQISNKAKKKARRESPEGVLRYKLDMCSKHGDLVEALHLYDEARREGVQLSQYHYNVILYLCSSGGSSVEVSGDWDGEKDSVLGLKRGFDIFGQMVADKVAPNEATFTSIARLAVAMDDPDKAFDLVKQMTSFGIPPKLRSYGPALFGFCKKGKVDNAYEVDAHMVEAGVMAEEPELSALLKVSADGKKADKVYEMLQRLRATVRQVSESTAEIVEDWFKSDDAATVGVDNWDENLVKEGIVKGGGGWHGQGWLGTGKWNVVRTQMNEKGVCRSCGEKLGCIDINPTETENFATSLTNLACQREVRADFTCFQEWLETHGPFDAVIDGANVGLINQHTLSFNQLNNVVNQLREMSPSKRLPLVILHKSRATGGPAQKPKNKYLLESWKKSGALYATPPGSNDDWYWLYASVSCKCLLVTNDEMRDHLFQLLGTSFFPRWKEKHQIRLSVSRNGLKLHMPPPYSIVIQESENGSWHVPTTTRQWLCATRTRLR

SEQ ID NO: 23 - protein, 828 aa, Carica papaya
MNLRPERQTTSLQSMNERTDENSLETLLSLKLEEKERVEKRFTKDKNGRRKLGFRQRREMDTGNSSLRSKGQKTVIKPLKDADSLAENGKTDKRSKESGVNQKVDKGTKNTSEKKISEKNVRKQPKKNKADSPGFKLRVELDMCSKRGDVTSAIQLYDKALKEEIKLEQYHYSVILYLCSSAAAGVVQPAKSGSISRTLNTLSLSNESYRVNAIELGESMDRSNGNASHTELNINFSNNEQLVGTDGGHFEDIDKMASSGVRFENLGNNCKEEENLIQFPNGSMKPNSQLWGKMGIGDHSNQKHMSGITQDHEILVTEDIKKYALHRGFEIYKKMRLDGVPMNEAILTAVARMAVSTGNGDMAFDMVKLMESLGITPRLRSYSPALSAFCTSGDIDKAFAVEKHMLAHGIHPEEHEIEALLKLSVEAGKGDKVYYLLHKLRTTVRKVLPSTADIIVKWFESEVASRVGKKKWDARLIKEAIENGGGGWHGQGWLGEGKWVVSRTVIGRDAFCKCCGEKLAMIDLDPLETENFAQSVASIARKREKNRSFQKFQKWLDYYGPYEAVIDAANVGLFSQKKFKPSKVNAIVNGMRQMLPSRKWPLIVLHNKRITGPKMNEPANKTLFDKWKNADALYATPTGSNDDWYWLYAAIKFKCLIVTNDEMRDHTFQLLGNDFFPRWKERHQVHFSFSDAGPVFHMPPPYSVVIQESEKGHWHIPIAAEHDYEAERIWLCIARSQSGKMRQTLPAAHQVDLQSLERHLGPSTPTDFNIKSNRSSASMAENGSKETREMYQNLKNILTGPMISNNCSVLSELEAAEKIGDCVIDFQI

SEQ ID NO: 24 - protein, 504 aa, Carica papaya
MASTDCNSRKKRKKNRNPEIDLLVNLQSCSKSKDLTTAISLYDSGISQNIRINQHHFSILLYICAASVTDPSSKSLAIERGFRIFDHMVSSGMSSNEASITSVARLAAAKGDGDYAFALIKDLVANGGLPRLRTYSPALLYFCENLEDGKAYEVEEHMDRMNVSLEEAEMAALLKVSAEVGKEERVYRYLHKLRGSVRCVSKETAKIIENWFSGEKGSAVGNGVEYSATEIREAVSKTGGGWHGLGWLAGRGKWVVRRANVEETGRCCCCGEQLACVDIDEIETEKFANSVAALAMEREAKLNFSDFQDWVEKHAPYEAIVDGANIGLYRQNFADGGFSIPQLDAVVKEMYCRSGNKWPLVILHDKRLRGLLENPSCRKVVEEWMDNGVVYKTPHGSNDDWYWLYAAVKLRCLLVTNDEMRDHIFELLGSSFFLKWKERHQVRYTFPKGSLKLQMPSPYSLAIQESENGSWHVPIASDSSLEYGKSWLCITRPSACASEVQVKS

SEQ ID NO: 25 - protein, 574 aa, Solanum tuberosum
MLVRRMGYFSPSLSIKTSPFFSLLTKTPFPFHHLRPIHFFKPIHTKSPQTHLFSMNRKTHFTTSAAFLQEPTNTKTLSNRSAKKARRDAPESVLRHQLDQCSKRGDLQEAIRLYEEAKLNNITLNVHHYNVLLYLCSSGSGTEGCGIEKGFQIFKQMGVNGVAPNEATFTSAARLAVAKQDPEMAFDLVKKMKSFGVPPKLRSYGPALFGFCEKGMADKAYEVDVHMGESGVVAEEAELSALLKVSSFSKKADKVYEMMHRLRGSVRQVCEETAGVVEDWFNSEFAAEVGLQDWDVRKVKEGVVKGGGGWHGQGWLGKGNWTVVRAEMDSSGACRSCGEKLVCIDIDPKETENFANSLVKLACEREVKANFVQFQDWLQKHGPFDAVVDGANVGLITQRNFNFSQLRSVVNKLRQMSESKKLPLVILHKSRTTGGPAQHPNNKKLLESWKKAGALYATPHGSNDDWYWLYAAVSSKGLLLTNDEMRDHLFQLLGTSFFPRWKEKHQIRMTASRDDGLKLHMPPPYSIVIQESEQGCWHVPTLTGDDLEIPRQWVCATRKKALHSLFRRNGESNH

SEQ ID NO: 26 - protein, 753 aa, Solanum tuberosum
MASIPFKPLQPTQFQFQLQLYSSTILLNPFKLHTTLPRISSSIHVTHVETTEQEISHTRRDSKTNSNENGSGFSSFTPKYKRVDSGQENGAKRVVLKDRNAKLKPKRRTSESSSSSSTNNNKAVESKKSKIDSTLRIGLDMCSKRGDVLSAIRLYDLALLQGIVMGQYHYAVLLYLCASAATGLIHPAKSGSGSRTLNAPNEPSSHNNSNEFNVIDHDSHLLGSSTVDEFVQFMKSSAKRCNLQSVRHDDSGIKVSEDVRHYALTRGFEIYEKMLSDKVQMNEATLTSVARMAMALGNGDMAFHVVKKMKEDGINPKLRSYGPSLSVFCNNGDVDKAFIVEQHMLENGIYPEEPELEALLKVSIEAGRSEKVYYLLHKLREGIRQVSPSTADLIAKWFNSKVASRVGKRKWDVRSIHKAIKNGGGGWHGQGWLGNGKWTVSRAIVGSDGCCKFCAEKLVTIDLDPEETEKFAKSVASIAAKRERNSSFQKFQRWLDYYGPFEAVIDGANVGLYSQRKFRPSKVNAVVNGIRQMLPSKKWPLIVLHNRRITGDKMDEPFNRSLVEKWKNADAIYATPTGSNDDWYWLYAAIKFRCLLVTNDEMRDHLFQLLGNDFFPKWKERHQVRFSFSETGPVFHMPPPCSIVIQESEEGYWHVPIASELESEEERTWLCIRRANSPMANQDSSTVNISKNVGDPTHKCPPTSSDPPHNQGDARSSTRRKNQVKVTGKTHGSHGRELKAAEELGSCVVDFQI

SEQ ID NO: 27 - protein, 551 aa, Solanum tuberosum
MDKAKNKKKNLTPEGQFRLSLDNCSKTKDLSTAISLYESAISEPSTIRLSNNHFNSFLYICSNSFSDPSTKNDAIQFGFRVFEHMGSCNITPNEATVTAVARLAAATDDGDRAFELAKGVGSCGKLRTYGPALFCFCKMGEADKTYQVEEHMRSLGLQLEEAELAGLLKVSVEKEREEKVYQYLHKLRMSIRSVSDSTAEIIQSWFGGEMASKVGLSNWDMDQVKQAILQNGGGWHGLGWLGKGKWLAQRSQIAPDGRCLTCGEQLVCVDIDRAETERFAESVASLAMEREVHSNFKEFQDWLENSDYDAVVDAANVGLFQQNFAEGGFSIAQLVAVVKELHSRSNKWPLVILHKKRVRTLLENAGYRELLEEWINEKILYGTPFGSNDDWYWLYAAVKRKCLLVTNDEMRDHIFELLGSSFFARWKERHQVKYTFVKGEIKLLMPPTYSVVIQESKIGSWHVPLAGEVVEESSRTWLCITRQASCESDNKQHASVVEASQVSELNQIAASCHSGSFTSQNGGSLNKCSGLAGKRKERSPSPTPSHSSLQS

SEQ ID NO: 28 - protein, 537 aa, Nicotiana tabacum
MVFRRMGYFSPCLSKTSPFFSLLTKTPYPFQLPHTIHFFKPIHTKFPHTDPFSMNQKTHLCTSAAFLQQPTSKTFSNSRSTKKARRDAPESVLRHKLDQCSKHGDLQEALRLYEEAKLNNISLNVHHYNVLLYLCSASCTKEFGIEKGFEIFKQMGVNGVTPNEATFTSAARLALAKQDPKMAFDIVKKMKSCGVPPKLRSYGPALFGFCDKGMADNAYEVDIHMGESGVVAEEAELSALEDWFNSECAAEIGVENWDVGKVKEGVVKGGGGSHGQGWLGKGNWSVVRAEMDSSGVCSSCGEKLVCIDIDPKETENFANSLAKLACEREVKANFVQFQEWLQKHGPFDAVVDGANVGLITQRSFNFSQLRNVVNKLRQMSKSNKLPLVILHKSRATGGPAQHPNNKKLLESWKKAGALYATPHGSNDDWYWLYAAVSSKGLLLTNDEMRDHLFQLLGTSFFPRWKEKHQIRMTASRDDGLELHMPPPYSIVIQESEHGCWHVPTVIGDDIEMPRQWVCATRRKALHSLFQPTGESNH

SEQ ID NO: 29 - protein, 581 aa, Nicotiana tabacum
  misc_feature (248)..(248): Xaa can be any naturally occurring amino acid
MASTSYITFKPLQQTQLQLCLCSKHSSTLFHSSFHTLLSPPTKYTPRILPSIQVKAHVTHLETRLSFEPEQEISGSRTNNENSSGFSSFSPKDKMVGMKSSRENLGGKTVILKDRNAKSGLKPKRSRELGSNKSKTETFEKEVRKDGGNRENMEKGSKKSKIDSTFKIGLDMCSKRGDVVGAIRLYELALQEGIAMGPYHYAVLLYLCASAATGVVQPAKSGSGSNRTLNSLDLPKGSTSVKIKASSXGKVTNLTNMLSFSSDTNCQTLDELVQLFESRAEASNTISDHGIKVSEDVKHYALKYGFEIYEKMRSEKVQMNEATLTSVARMAMALGNGNMAFDVVRLIKEYGINPRLRSYGPALSVFCNNGDVDKAFMVEEHMLEHGVYPEEPELEALLKVSVEAGRSEKVYYLLHKLREGVRQVSPSTADLIEKWFNQAGVQGVGKRKWDERTYAKLFKTGGGGWHGQGLVGDDWYWLYAAIKFKCLIVTNDEMRDHLFQLLGNDFFPKWKERHQVHFSFSETGPVLHMPPPCSVVIQESEKGYWHVPIVSQQGSEEERTWLCIRRANSPLAKQESSSVDI

SEQ ID NO: 30 - protein, 535 aa, Nicotiana tabacum
MDKNKKKKKNLTPEVQFRLSLDNCSKTKDLSTAISLYESALSTIRFSNNHFNSFLYICSNAVSDPSTKNPAIEFGFRIFDHMVSSNVTPNEATVTAVARLAAATDDGDKAFELAKGVGNCGKLRTYGPALFCYCKMGEADKAYQVEDHMRSIGLQLEEAELVGLLKASVVKEREEKVYQYLHKLRMSVRSVSASAAEIIQSWFGGEMAAKLGLSDWDMGQVKEAILQNGGGWHGRGWLGKGKWIVQRSQIAPDGRCLTCREQLVCVDIDKAETERFAEAVASLAMEREVHSNFKEFQDWLEQHSEYDAVVDAANVGLYQQNFAEGGFSIAQLVTVVTRIAHKWHWCIHKSVFVHSENAYIESCLRVINEKVLYGTPFGSNDDWYWLYAAVKRKCLLVTNDEMRDHIFELLGSSFFAIWKERHQVKYTFVKGEPKLLMPPTYSVVIQESENGSWHVPLAGEVAEESSRSWLCMSRHDKQHTSVEAAEVSELVCSDQIEDSCHSDSFASQNGLNTCSGLAGKRKERSPSPSHSSLQS

SEQ ID NO: 31 - protein, 558 aa, Setaria italica
MRVAAAAAGALRPTAATFLLFSPLRQHRRPTLHLPFARRRRHSYSSTATVADPTPTLEDSGGARGEAEGKAARRRRARESPEGLLRHQLDMCSRNADLTTALRLYDAALSPDSPVPLSLHHYNCLLYLCSNAAASDPESSAAAAQRGFDIFARMEADGVQPNEATLTSVARLAAATRDPAMAFSVVRRMAAAGTPPRLRTYGPALFAYCDAKDADGAGQVEAHMDASGVVPEEPELAALLRVNADKGRADEVYRLLHRTRALVRQVCDTTAQVVEAWFRSDAASEAGVDKWDPSQVREGVVKGGGGWHGQGWLGKGQWSVGRSEMDKEGTCQRCGERLVCIDIDPSETDNFANSLTELAIKREVREDFLGFQRWLRRHGPFDAVIDAANVGLYNSKAFSFSQVNSVANAIQRVTKSKKLPLIILHRSRVNGGPAKAPFNQKILEGWRNAGALYATPPGSNDDWYWLYAAVSCRSLLVTNDEMRDHLFQLLGTGFFPRWKEKHQVRLTFSGRGPTLHLPPPYSIVIQESEDGTWHVPTTTGDDIEKPRQWICSTRKSFK

SEQ ID NO: 32 - protein, 731 aa, Setaria italica
MASLFATHSLPAHHRHILFPASSSPLIGSHRCFVPPLSCRAREVLDVMPRRDGGRPPRTEEGRTGSAGVRHGANGGTVRGDTTSREAGTPLQREGSRGVPRPWKKGDRVVGEERLDWESQEKNWRRGPIRTGEQEWQRDGKRWTRGGNGMWEKESGNSGNSRDVDRGSRNVTKKKMRVKGGEQGGKLRVLLDMCSKRGDVMRAISLFDSAIEDGIRLGQHHYNVLLYLCSSAALGFVQPAKSGNTASGITSIGPAQKLDSSPSGSLGGSEVDDASEGLVQDQEKEKAEMLPSGDLTVQTITIPVGDELREYARARGFEIFEKMCAEKERVQMSEAALTAKARMALSMGDGDMAFEVVKQMKDLGITPKLRSYGPALTAFCNSGNVEKAFEVEAHMLECGITPEEAELKMLLRVSVVGRRGDKVYYLLHKFRAAVRQVSLSTAQLFEAWFRSPTASKVGKRKWDAGVISKAIENNGGGWHGFGWLGRGKWTVTRSHINKNGACLACGEKLTIIDLDPKETEDFATFVSKLAIKRERNSNFEKFQKWLEKHGPFEAVVDAANVGLFSHKHLSLNKVNAVADAIRQRFASRKWPLIVLHNRHLTGERMKKPGNHKLVEKWKQANSIYATPNGSNDDWYWLYAAIRCKCLIITNDEMRDHTFQILEKDFFPKWKERHQVHFTYDESSVTFRMPPPYSVVIQESEKGHLHIPISEEGLLEKDRTWLCVTRRNSQER

SEQ ID NO: 33 - protein, 586 aa, Setaria italica
MGSISLWACGRLWPQTPPLALRALLLAPCSNRGRRRATHTAMATTTRRRPRRGSKGSNPDLSRTLTDCTRRGDAAAAIAAFDDAVSDPDAPARLAAHQYNQLLHLLATADRSSFPSAAAAARRVFAHMLQAGAPPSEATITSLARVTAAPDADNPASAADEAFELVATMREKHGLAPRLRSYSPVLAAFRRAGDASKAYAVEAHMAASGVSPEEPELAALLDISSTAGDADKVYEYMHKLRQTVDCVTEETAQVVEGWFSSDNAGVAGKAEWDAAQVKDAIVLNGGGCHRLGWLGTGPWTVQRVRAGADCQCAGCKCQLACVDIDMEETQRFADAVAALALERETKANFSQFQEWLEENKEYEAIVDGANIALYQQNFAEGGFSLTQLDAVITELRGRYHGKWPLVILHNKRIAKLMENSSNRHLIETWRANGALYTTPSGSNDDWYWLYAAIKLNCLLVTNDEMRDHIFELLGSSFFPKWKHRHRVKYTFNKGKAVLVMPPPYSSEIQESEVGSWHVPLEEKSGDERVRIWLCIGRTGTCKEPDEVPTTNGVVQEVPPNEESNGVQQSLQEDKAESITGKRKDRD

SEQ ID NO: 34 - protein, 553 aa, Sorghum bicolor
MRAAMAAAALRPTAATLRFLFTPPHQRRRLLVEHLPFARRRRHSSTATAPALEDSSPSNGEGKAARRRRARESPEGLLRHQLDMCSRNADLTTALRLYDDALSPDTPVPLSLHHYNCLLYLCSNAAATDTDTDSSTAAAQRGFDIFARMEADGVQPNEATLTSVARLAAATRDPAMAFSVVRRMAAAGTPPRLRSYGPALFAYCDAKDADGAKQVEAHMDASGVVPEEPELAALLRVNADKGKADEVYRLLHRTRALVRQVCDTTAQVVEAWFRSDAASQAGVDKWDPSKVKEGVVKGGGGWHGQGWLGKGAWSVGWTEMDKDGTCQRCGEKLVCIDIDPSETDNFANSLTELAIKREVKEDFLGFQNWLRRHGPFDAVIDAANVGLYNSKAFSFSQVNSVVNAIQRVTKSKKLPLIILHRNRVNGGPAKAPYNQKILESWRNAGALYATPPGSNDDWYWLYAAVSCRSLLVTNDEMRDHLFQLLGTSFFPRWKEKHQVRLTFSGRGPTLHLPPPYSIVIQESEDGSWHVPTTTGDDIEKPRQWMCTTRKSSK

SEQ ID NO: 35 - protein, 655 aa, Sorghum bicolor
MAYLSTTRFIPVYHRCIFFSASSSPPIVTRRCPVPTLSCHGRDVLDVMPNRDSRIPGTEESRAGPAGPPRGTNGPTVREDATAQEARTPLWREGSRGAPRTWRKGDRVVLQERVEWVSQERSWRRGLTRSLGSEGPRAGKRWTREGNGMRAKESGKVGNSRDEGTGRRNASKKMKRSKGGEYAGKLRVELDMCSKRGDVMGAIALYDSAVEEGVRLGQHHYNVLLYLCSSASLGDDLREYACARGFEIFEKMCSEKERVQMSEAALTAKARMALSMGDSDMAFEIVKQMKDLGLKPKLRSYGPALTAFCNGGNVEKAFEVEAHMLESGITPEEAELETLLRASVVGRRGDKVYYLMHKFRTTVRQVSPSTAELFEVWFRSPTASKVGKRKWDTGAIVKAIENNGGGWHGFGWLGRGKWTVTRSNINKNGVCLACGEKLAIIDLDPKETEDFATFVAKLAIKRERNSNFENFQKWLKKHGPFEAVVDAANVGLFGHRHLSLSKACILLRFTSRKWPLIVLHNKHLTGEHMKKPGNHKLVEKWKQANSIYATPTGSNDDWYWLYAAIRCNCLIVTNDEMRDHTFQILERNFFPKWKERHQVHFTIEDSCVTFQMPPPYSVVIQESDKGHWHIPVSEEALLEKDRTWLCVTRQNSQAQ

SEQ ID NO: 36 - protein, 526 aa, Sorghum bicolor
MASTATSRRRPRRGSKGPNADLCRTLTDCTRLAAHQYNQLLHLLASADRSSFPGPAAAAAARRVFAHMLQAGAPPSEATITSLARVIAAADDPGSSAADEAFELVATMKDKYGLSPRLRSYGPVLAAFRSAGEAAKAYAVEAHMTASGVSPEEPELAALLDVSSRAGDADKVYEYMHKLRQAVDCVSEETAGVVEAWFRSDKAAMAGKSEWNAAQVKDAIVANGGGCHRLGWLGTGPWTMQRVRVGADDQCAGCRYRLACIDIDMEETRKFADSVAGLALERETKTNFSRFQEWLEANKEYQAIVDGANIALYQQNFAEGGFSLTQQLDAVITELRDRYHGKWPLVILHNKRIAKLMENSSNRHLIETWRTNGALYTSPSGSNDDWYWLYAAIKLNCLLVTNDEMRDHIFELLGSSFFPKWKQRHRVKYTFNKGKAVLVMPPSYSSEIQESEMGSWHIPMEEKSGDERGRIWLCIGRGGSCKEHGEVPTTNGVVHEIPPTEASKVVQQRLAENKNETISGKRKDRD

SEQ ID NO: 37 - protein, 414 aa, Sorghum bicolor
MVESRSNSRLAAAIRSLAVAVAVAEPSSAASHPIPAYTVSGSSAGTDAAPYRMPHASSASVSPSPSPSRRRAIPAAASHAEAPLAAARSDKAATAGKSEWNAAQVKDAIVANGGGCHRLGWLGTGPWTVQRVRVGADDHCGGCRYRLACIDIDMEETRRFADSVAGLALERETKTNFSRFQEWLEANKEYQAIVDGANIALYQQNFAEGGFSLTQLDAVITELRDRYHGKWPLVILHDKRIAKLMENSSNRHLIETWRTNGALYTSPSGSNDDWYWLYAAIKLNCLLVTNDEMRDHIFELLGSSFFPKWKQRHRVKYTFNKGKAVLVMPPPYSSEVQESEMGAWHIPMEEKSGDERGRIWLCIGRGGSCKEHGEVPATNGVVHEIPPTEASNVVQQRLAENKDESITGKRKDRD

SEQ ID NO: 38 - protein, 692 aa, Hordeum vulgare
MRLAAAAGVLRPTAALLFHSRSRPHRLLPSPRRSSLPFARRRRHSYSSSTATALDDPPPPPSPDAPTPTGQGGDTKAARRRRARESPEGLLKHRLDMCSRDADLATALQLYEAAVDPATAVPLALHHYNCLLYLCSNSGDADAARRGFEIFAAMEAQGVEPNEATLTSLARLAAAVRDPAMAFSVVRRMAAAGIPPRLRSYGPALFAYCDARDANGAAEVEAHMDAGGVVPEETELTALLRVNADIGRADQVYRVLHRTRTLVRQVCQATAQVVEAWFRSDAAAEAGVDKWDARKVREGVVKGGGGWHGQGWLGKGQWDVGQSEMDKDGRCQRCGEKLVCIDIDPSETETFAKSLAELACNREVRDDFVRFQDWLHRHGPFDAVIDAANVGLYKSKAFSFSQVNSVVNGIQRVTKSKKLPLIVLHRSRVNCGPAKTPQNQKLIESWRNAGALYSTPPGSNDDWYWLYAAVSCRSLLVTNDEMRDHLFQLLGTSFFPRWKEKHQVRLTYSGRGPTFHLPPPYSIVIQESEAGSWHVPTTTGDDIESPRQWVCATRKTSERPPSPPPQARATSKTLEGPPSPPPQARATGKTSEGPPSPLPQARATRKTSEGPPSPPPQARTTSKTLERPASSPPQAHAGSKTLDRPPSPLPQARAARKTSGRLPSPPPQASATNKNAERPSPSPKARLSDLGW

SEQ ID NO: 39 - protein, 544 aa, Hordeum vulgare
MATAADGGTRRRRGRGGKGPNSDLSRTLTDCTRRGDAAAAMAAFDAAASGPDDLRLAAHQYNQLLHLLATAPFPGHPAAAARRVFAHMLGAGAAPSEATITSLARVVAADADAEGADEAFALVSTMRDKYGLAPRLRSYSPVLAAFRRAGDAGKAYAVEAHMAASAVSPEEPEVAALLEVSAKAGDADKVYEYMHKLRRAVGCVTEETAEVLEGWFRSEEAAAAGKAEWDACRVKEAIVAKGGGCHQLGWLRTGPWTVQRVRVAADGECGGCGCRLASVDIDMEDTHKFADSISGLALERETKANFSHFQEWLEEHKEYEAIVDGANIALYQQNFSEGGFSLVQLDAVVTELRDRYNGKWPLVVLHNKRIAKLMETPSNRHLIEIWRANGALYTSPSGSNDDWYWLYAAIGLNCLLVTNDEMRDHIFELLGSSSFFYKWKQRHRVKYTFNKGKAVLVLPPPYSSEIQESETGSWHVPIEEKSGDERARTWLCIGRTDLTKLPREPLVANGVAQDLSPSEASNGAGQRQSAEQAAPVTGKRKDRD

SEQ ID NO: 40 - protein, 552 aa, Oryza officinalis
MRLAAAAALRPSAALLLLLPPHRRTASLRRSSLPFARPRRHSTTTTTAETRPKPNESNAARRRRARDSPEGLLKAKLDICSRDNDLPTALTLYEAAISPDSLIPLSVGHYNCLLYLCANAAAASSPDAAHRGFDIFSRMEADGVQPNEATLTIVARLAAARRDPAMAFSIVRRMATAGSAPHLRSYGPALFAYCDAGDADGATEVEAHMDASGVVPEEPELAALLRVNSARGRPEQVYRILHRARVLLRQVADATAQLLESWFASHAASEAGLHDWDATKVKEGLRNGGGGWHGQGWLGKGQWTVGRSEMDKDGTCQRCGEKLVCIDIDPSETQSFAESVAQIAINRDANFIKFQEWLECHGPFDAVIDAANVGLYNRNSFSFYEVNRVVNGIQRITKSKKLPLIILHKNRVNGGPAKLPQNQKLLECWQRAGALYATPPGSDDDWYWLYAAVICRSLLVTNDEMRDHLFQLLGTSFFPRWKEKHQVRLTFSGRGWNFHLPPPYSIVIQESEEGSWHVPTTNGDDIEKPRQWICATRKISGKSSQAFARAVG

SEQ ID NO: 41 - protein, 590 aa, Manihot esculenta
MLRGSSLAPSFNRNSPLFSFFVQMPLLSVFRNSSLAFHRPLLHYHSYLFAKPVRDIQAYDLPMDRRAHLCCSALSTTPKVHESSALAMDKVSNKSKRKARQESPEGVLKLKLDMCSKHGDVVQALHLYDEARTNGVQLNQHHYSVLLYLCSSGSSVKLNGNVVDANASSLYYKRGFEIFQQMIIDKVAPSEATFTNAARLALALEDPEMAFDLVKQMKGFNILPKLRSYGPALFGFCSKGMADRAYEVDAHMAESGVMPEEPELSALLKLSADVKRADKVYDTLHRLRAIIRQVTDSTLGIIEDWFNSEDASKIGEENWDTSKVRKGILMGGGGWHGQGWLGSGQWRAVRTQIDEKGGCHSCGEKLVCIDIDPRETENFATSLSNLACQREVRTDFVRFQEWLQQHGPFDAVVDGANLGLVNQRTFSFYQLNSVVGKLREMSPSKRLPLIILHKRRVTGGPATNPKNKMLLEFWKKSGALYTTPAGSNDDWYWLYAAVTCNCLLVTNDEMRDHLFQLLGTSFFPRWKEKHQVRISVSRSGLTLQMPPPYSIVIQESENGSWHVPTIAGDDLETPRQWLCATRAKNKVIPF

SEQ ID NO: 42 - protein, 757 aa, Manihot esculenta
MASFPFNTLQPKHHLSTTLCKYPLSLNTLNFHCSFHFLTFYPFEHKPSFVRRASGNDINIKTKLSTANHENPTKTKNLRIRKSSSTVDERVGRKFVNNLVESVIEESIDERFTKNRNGRKDMGFRKRRDIDSGDLSTRFRDGNKKREALEIMDLQAINGKKLEKKTKKNADNQVKEKKIAKGSKENKPDSVEVKFRLDLDMCSKKGDVMGAIQLYDLALKEGIKMEQYHHAVLLYLCSSAAVDEDIKKYALRRGFEIYEKMCTDEVPVNEATLTAVARMAMSMGNGDMAFDMVKRMKPLGLNPRLRSYGPALSTFCNNGDVDKAFAVEKHMLEHGVHPEEPELEALLRVSVEAGKGDKVYYLLHKLRTTVRKIPPCTADIVVRWFKSKAASRVGKTKWNKRVIKEAIENGGGGWHGRGWLGKGKWNVSFTSIGPDAFCRCCGEKLATIDLDPAETQNFAESVASIAIKREKNSSFEKFQKWLNYYGPFEAVIDGANVGLLSEKIFIPSKINAIANGIRQQLPSKRWPLIVLHNRRVSGHNMNEPANKALIEKWKNADALYATPTGSNDDWYWLYAAIKFKCLLVTNDEMRDHTFQLLGNDFFPKWKERHQVHFNFSDVGPVFHMPPCFSVVIQESERGNWHIPIATDDDYEPERNWLCITRANSSVARHDSMTTRTEDSQSVDHSNDKQAMSPMQNSLKEKQEYNQCSLEVLSNSPQAVYKNLRNVLLASGFTERRTILQEIEAAEKLGGCVIDFQI

SEQ ID NO: 43 - protein, 560 aa, Manihot esculenta
MATAQGKKKKQNKNQTPESQFNYNLNFFSKSKDLRSAVSLYDSAVSSDTRLSQHHFNTLLYLCSISLSDPSTKELALQYGVRVFDHMVANGIKPNEASITAVARLAAAKGDGDYAFDLVKNMGVHNELPRLRTYDPVLLCFCDKLEADKAYEVEVHMESMGVSLEETELAALLKVSAETGNEERFYGYLQKLRKTVRCVREETAKIIEDWFQNFEHNGQELNVGLVREAVTRNGGGWHGIGWIGKGRWVVRRGNVDNDGKCFCCGEHLARIDIDDTETERFAASVAGLAMEREVKAYFNEFQDWLDKHPNYEAIVDGANVGLYQQNFAEGGFSVSQLDAVVKELYGQSGNWPLIVLHNKRVRALLENPSHSKLIQEWIEKEVLYTTPHGSNDDWYWLYAAVKLRCLLVTNDEMRDHIFELLGSNFFLRWKERHQVRYTFMKGNLKLHMPGPFSVVIQESEKGAWHVPIAGDGNEDSKQSWLCITRPSAWGEPGEDAVSMETCENGDSVWNGCKLLSPCKPKCISSCDSEPERQDSFQESDNKPATMTGKRKERSPSPSIS

SEQ ID NO: 44 - protein, 574 aa, Theobroma cacao
MLGVNPYVPSMSMFKKIPFSFIYRNCFHRSLLPFGMCYYHLFLKPVSISNVHVNYFAVDKTRNLSAVATAAKSTVNTSNSTNAMSNKARKKAHRESPESVLKYKLDMCSKHGKLVEALRLYEEGRSNGVTLKQHHYNVLLYLCAREASGDGVELKELGLKRGFEIFQKMVGDKVSPNETAFTSMARLAVAREDLDLAFELVKQMKSLGIPPKLRSYGPALFGFCEKGNAEKGYELDAHMAESGVTPEEPELSALLKVSADTKNADKVYDMLQRLRATVRQVSESTFQIIEDWFKSEDAAKVGVESWDVNKIKKGVVDGGGGWHGQGWLGSGRWRVMRTKMTENGVCRCCGEKLVSIDIDPKETENFATKLTELACNREVKADFIRFQEWLQQHGPFDAVVDGANVGLIKADTFNFNQLNNVVNQLRQMSPSKRSPLVILHQGRVTNGPARNPNNRNWLDSWKRAGALYATPAGSNDDWYWLYAAVSCKCLLVTNDEMRDHLFQLLGTSFFPRWKEKHQVRLSMTRLGLSLHMPPPYSIVIQESESGSWHVPTIADDDLLNPRQWLCVGRTRNKS

SEQ ID NO: 45 - protein, 877 aa, Theobroma cacao
MFSTSIVSLIILFSSPPKHKISQFFVDRRHVRHHFHAKFSTKDYETSTKTGNSKSKKEIGSGFNSLRSGNEGAERNSLENLFSSVLEGKAERKRYAKDKNARKRDKYFERGREMGSGDSSLRAKDENMGSKQKSSKNVNNLVAKEKVEGKTKDGDGLVKEKRLGKRSKKDQANSPEVHLRVQLDMCSKRGDVMGAIQLYDKALREKIKMGQYHYAVLLYLCSSAAVGVVQPAKSGSGSRPLNMLNVSNEASSMNSMGLGEPIDKDSENSSASELSNPILNNGKLVDSSRSQGNIDKLKVRFSESFCNLDNTFPDKNLNQFSNGSPKPYSRLSEGSSYQKKRDEDHLDIDDKSSSDREDYEIGVSEDVKKYALLKGFEIYEKMCLDNVPMNEATLTAVARMAMSMGNGDMAFDVVKKMNQLGINPRLRSYGPALSVFCNIGDVDKAFEVEKHMLEHGIHPEEPELEALLRVSVEAGRGDNVYYLLHKLRTSVRKVSPSTADKIVKWFESKEASRLGKRTMDQRFIKEAIENGGGGWHGQGWLGKGRWIISHTAVGADALCKCCGEKLALIDLDPVETEKFAESVASIATKREKHFSFQKFQKWLDYYGPFEAVVDAANVGLFSQRRFMPSKVNAVVNGIRQKLPSKKWPLIVLHNKRITGQKMDEPVNKALIEKWKNADALYATPTGSNDDWYWLYAAIKFKCLIVTNDEMRDHTFQLLGNDFFPKWKERHQVHFSFSNAGPVFYMPPPCSVVIQESEKGHWHIPIASELDYDTERTWLCIRRAKSHVVKEDSSTIPEDLQPLDRNKECTRPTIQTEVNTNSLSLKDGNHDKPQKHTEEIYKNIRDILSVPVPSDQCTVLSEIEAAEMLGNCVIDFQI

SEQ ID NO: 46 - protein, 566 aa, Theobroma cacao
MATPSHKGNPTNSTKRKKNHKNPEANFLYELNSCSKSKDLEAAISLYESAISNKTRLNQHHFNTLLYLCSTISTDPESKSLALTYGFRVFDHMITLNIHPNEASITAIARLAAAKGDGDYAFEMIKKLGDYRVLPRLRTYEPALFCFCQKLEAEKAYEVEADINKMGLSLEEPQIAALLKLSAETGRGEGVYEYLQKLRRGVRWVSEETGKVLEDWFSREGSEVGFEGATYEVSFVKEAVLRNGGGWHGLGWIGKGKWVVRKGKVEPNGRCCCCGERLGCVDIDDVETEKFAQSVAGLAMEREVKANFREFQEWLEQNADYEAIVDGANIGLYQQNFAEGGFSILQLDAVIKEMYGRSGNKWPLIILHNKRVRALLENPSYRKLVEEWMNNGFLYTTPHGSNDDWYWLYAAVKLRCLLVTNDEMRDHIFELLGSSFFLKWKERHQVRYTFPKGILKLQMPPSYSVVIQESEKGSWHVPIVCDGNEESARTWLCITRPGACEDLGKTASNIETCENGNGPCCKSEMSNTGDFEILPSDNRNQASQDFFQMSYAETPSITGKRKERSP

SEQ ID NO: 47 - protein, 588 aa, Cucumis sativus
MTTLASSLMSSFAKTSPFFLYFTKIPVFPCQNPLRASLRTYSCRSIVFSKNILKYSCNSYFSIHTVRYLCNVASAATSSVNASSTSSSNKVSHKLRKKALKEAPESVLKYNLDMCSKYGQVVKALELYDEARSNGIQLNQHHYNVLLYLCSSPSLLETSGANNLSSVVLSRGFEIFQQMMTDKVSPNEATFTSLARIAAARDDPEMAFSLVKQMKDYHIAPRLRSYGPALFGFCRKLMPKEAYEVDSHMLASAVEPEELELSALLKLSSDVKKADKVYELLHRLRRTVRQVSEPTAKVIEDWFNSESASEVGKKHWDVDKVRECIVRRGGGWHGEGWLGSGKWKLVRTGIDDNGVCHSCAQKLVCIDIDPKETEDFASSLTKLANQRVKADFNNFQGWLEKHGPFDAVIDGANVGLVNERQFNFIQLKRAVYQMRELSPSKKMPLIILHKRRITDGPARNPNNMKLIETWKNCGALYATPYSVNDDWYWLYAAVRFKCLLLTNDEMRDHLFQLLGNTFFPQWKEKHQVRLSVSRNGLKLHMPPSYSIVIQESENGSLHVPTTTGDDLETPREWLCATRPTNTSMSGFE

SEQ ID NO: 48 - protein, 740 aa, Cucumis sativus
MASSSLISAQQNHFFSSTTLCKFSSTITIFQSPCLLPFPTFSSPQHTIPLLRVGDGVVREFSATKNRKPSSKPSFSMTQKLNKNGSPHLGHGNETLVKNSVEDLVNLEVDERTRKRFEKGKNARDSSRSVNGMKMGDGISFLKTSTDSASLKVSRDGGKIKEKRKGNQVVEEKGKLLKGNNETPFRANLDMCSKTGDFIGAIKLYEWAQKEGINLEQYHYAVILYLCSSAALDFKKYALETGFEIYEKMCAENIPMNEATLTSVARMAMSMGDGDKAFDMVKQMKPLGLNPRLRSYGPALSTFCKNGKLEKAFSVEKHMLEHGVYPEEPELAALLRVSINASNAEKVYYLLHKLRTSVRQVLPSTADLIITWFKSKDAARVGKVKLDRKIIKKAIGNGGGGWHGLGWLGRGKWSVSSTNVGKDGLCKSCGEKLATIDLDPIETENFAESVAAIVTQREKNSSFQKFQKWLEYYGPFEAVIDAANVGLFSQRKFAPSKVNLIANGIRQKLPSKKWPLIILHNRRITGRKMEEPVNKTLIEKWKNADALYATPTGSNDDWYWLYAAIKFKCLIVTNDEMRDHTFQLLGNDFFPRWKERHQVHFSFSATGPVFHMPPPCSVVIQESENGHWHVPLASEHSYEEDRKWLCITRGNLQSQMARQEPPRKTEPQSLLLNKGNLGTRADVDIKKQPSTQVLTKNSSQDNYKSLKQILSAAVFSDKCNLLKEMEAAEKLGGCTIDFQI

SEQ ID NO: 49 - protein, 538 aa, Cucumis sativus
MDSTGSAKARKKSKNQSPEVKFQLDLTDCSRRKDLLSAITLCETAVSEKLKFNQQHFNTLLYLCSTAISDPSLKESAVSFGFRVYNLLQSIGVIPNEATVTAVARLAAAKRDGDSAFELVKTIGKYKVTPRLRTYDPALICFCENLEVDKAYEVEQHMNSAGVELEEPQISALLKLSSDTGKEDKVYEYLHKLRRVVKCVSESTAKIIEGWFCSEKASDIGESTMDIGLIREAILSNGGGWHGKGWIGKGNWVVKRTNVYSSGKCCCCAQQLVGVDISCAETENFAQSLAALAIEREAQPNFISFQEWLEVHNHCDAIVDGANVGLYQQNFADSGFNLSQVEAVVKELCKMSGGKWPLVLWHNKRTRASLDNSSHRKVVEEWIDKGVLYSTPIGSNDDWYWLYAAVKLKCLLVTNDEMRDHIFELLGNDLFLRWKEKHQIRYTFVKGQLRLEMPPPYSVVIQESETGSWHVPIAANDSELERTWLCVTRPGVSAASDVAVNGETCESIEAQGSCASMSVKLLDSSVARKRKERPSSTS

SEQ ID NO: 50 - protein, 578 aa, Vitis vinifera
MLTRAGGLSFFFAKTPILCHVGHTRLRSLLYGCSHHHFKPTTYSPYIKVRIFMNKSAHFSNLALSATNKYIPESSAVAETMSNKARKKARRESPEGVLRFKLDMCSKRGDVVEALRLYDEARSRGVPLSQHHYNVLLYLCSCSGSNGDENVVNLALKRGFEIFKQMGVDGIEPNEATFTSAARLACAMEDPEMAFNLVKQMKSCGIPPKLRSYGPPLFGFCKKGDADRAYEVDAHMMESGVVAEEPELCALLGLSVESRRVDRVYEMVHRLRASVRQVSESTAEVVERWFNSEDAAGVGEENWDVGKVREGVVKGGGGWHGQGWLGKGKWKVVRTEMDEAGVCQSCGEKLVCIDIDPRETENFASSLTKLACQREVKADFVQFQEWLQRHGPFDAVVDGANVSLINQKSFSFFELNSVVNRLRQISPSKRLPLVILHRSRVTGGPAQNPNNKKLIESWKKSGALYATPAGSNDDWYWLYAAVNCNCLLVTNDEMRDHLFQLLGTSFFPRWKEKHQVRLTITRRGPVLHMPPPYSIVIQESEQGSWHVPTVTGDDLETPRQWLCATRTRKNHRHPQHLE

SEQ ID NO: 51 - protein, 578 aa, Vitis vinifera
MLTRARCLSFFFAKTPILCHVGHTRLRPLLHGCSHHHFKPTTYSPYIKDRIFMNKSAHFSNLALSATNKYIPESSAAAKTMSNKARKKARRESPEGVLRFKLDMCSKRGDVVEALRLYDEARSLGVPLSQHNYNVLLYLCSCSGSNGDENVVNLALKRGFEIFKQMGVDGIEPNEATFTSAARLACAMEDPEMAFNLVKQMKSCGIPPKLRSYGPPLFGFCKKGDANRAYEVDAHMVESGVVAEEPELCALLGLSVESRWVDQVYEMMHRLRASVRQVSESTAEVVERWFNSEDAAGVGEENWDVGKVREGVVKGGGGWHGQGWLGKGKWKVGRTEMDEAGVCQSCGEKLVGIDIDPRETENFASSLTKLACQREVKADFVQFQEWLQWHGPFDAVVDGANVSLINQKSFSFFELNSVVNCLRQISPSKQLPLVILHRSRVTGGPAQNPNNEKLIQSWKKSGALYATPAGSNDDWYWLYAAVNGNCLLVTNDEMRDHLFQLLGTSFFPRWKEKHQVRLTMTRRGPVLHMPPPYSIVIQESEQGSWHVPTVIGDDLETPRQWLCATRTRKNHRHPQHLE

SEQ ID NO: 52 - protein, 756 aa, Vitis vinifera
MALFTINNTLHQKHFFCNCKCPSPFNAFKFHHSSHFLTFSSPKHTPPPRKSALLIVRPHVGHLYAKLCTADHEPSTADMGGRTGKETGSGFSSYGSKGERVGRKSVKTHVGWAVEEKNEKRFTRERYSKKRLDSRRNGGTSSKFPSLKSESKNLVNKSLKANEKEEEKSKKGDADKVREEMEKGSKKNKVDSQEGLLRVGLEMCSKNGDVMGALELYDSALREGIELGQYHYTVLLYLCSSAALDFKKYALRRGFEIYEKMCLEKVPMNEATLTSVARMAMSMGNGDMAFDMVKQMKPLGINPRLRSYGPALSAFCNNGDIEKAFGVEEHMLEHGVYPEEPELEALLRVGIEAGKSDKVYYVLHKLRTSVRQVSHSTANLIEKWFKSNAAAAAGKGNWDQRLISEAIVNGGGGWHGQGWLGKGKWNVSHTNVGADGLCLCCGEKLATIDLDPTETEKFAESVASIAIKREKNSSFQKFQKWLDYYGPYEAVVDAANVGLFSQRRFIPSKVNAIVNGIRQMLPSKKWPLIILHNKRITGKKMDEPANRALIEKWKNADALYTTPTGSNDDWYWLYAAIKFKCLIVTNDEMRDHIFQLLGNDFFPKWKERHQVHFSFSDSGPVFHMPPPCSVIIQESENGHWHIPVASEHDSEGERTWLCVTRANSQMAKQSPSPRNKESQYPCYDKRRVRSDTQTEIHKELSSSNHRNQEKSKAPPQEIYRNLRNILSASIFPTHSTVLSEIEAAEKLGNCIIDFQI

SEQ ID NO: 53 - protein, 551 aa, Vitis vinifera
MKKKKNNKTTVEGKFRFDLDTCSKRRDLSGAVALFESAVSQNFRLIHYHFNALLYLCTISIDEPSSKALALDYGFRIFDHMVNSGVTPNEATITAVARLAAAKSDGDLAFEVVRTMGKYELSPRLRTYGPALYWFCANLEGEKAWAVEEHMVSMGVHPEEPELAALLKVSAEMGRGDKVYAYLHKLRTAVRSVSESTAEIIEGWFCGEAASEVGGVDCCLGAIEEVALKNGGGWHGQGWIGKGKWLVCRAKVDSSGQCGSCREQLATVDIDRAETETFLESVAAMAMEREVRSNFREFQDWLDKHADYEAIVDGANIGLYQQNFANGEFSIPQLDAVVKELYDRSQKKRPLVILHNKRFRKLSENASNRKLLQEWLTQGVLYTTPNGSNDDWYWLYAAVKLKCLLVTNDEMRDHIFELLGSSFFLKWKERHQVRYTFVKGNVKLLMPPSYSLFIQESVKGTWHVPVASESSDESLRTWHCITRPSSHELNGKASVNLETCEIDRQEQCDFKLSSCKSEGLRNGSCENKTTTMTGKRKDRSPSPSPSPMQRH

SEQ ID NO: 54 - protein, 560 aa, Glycine max
MMARLAPPFSIFRQSHYWRPLLSSHNAKRTLTAATNFSITSLARTPKSRDEGTTTIVKLSSKARRKAFYESPEGVLLRKLNECSKDGNVAQALCHYDEARKLGVLLNLDHYNKLLYLCSIESAAGFPNLGLKRGFEVFQQMLNDRVQPNEATFTNAARLAAANEDPDMAFELLKQMKNVAIAPKLRSYEPALFGFCKRGDAEKAYLVDADMVESGIVAEEPELSALLEVSVNAKKEDKVYDILHRLRSTLRQVSESTLGIVEDWFNSEYAAKIGKEKWDVKKVREGIAQGGGGWHGQGWLGSGRWKVANTQVNEDGVCPLCGEKLVSIDIDPKETENFAASLSKLACQKEAKANFVHFQTWLEQHGPFDAVVDGANVGLANGHNFSFSQLNTVVEQLRQISPSKRLPLIILHISRVRGGPAQNPKNMRLIENWKKNGALYATPQGSNDDWYWLYAAVSCKCLLLTNDEMRDHLFQLLGSNFFPRWKEKHQVRTSASTCGHSIIMPPRYSIVIQESANGSWHVPTVTTDDHEIPRKWLCATRSRKDSLHNLWTSSSKSDCT

SEQ ID NO: 55 - protein, 553 aa, Glycine max
MAGIFRQSHYWRPLLSSHNAKRTLTAATNFSITSLARTPKSRDEGTTTIVKLSSKARRKAFYESPEGVLLRKLNECSKDGNVAQALCHYDEARKLGVLLNLDHYNKLLYLCSIESAAGFPNLGLKRGFEVFQQMLNDRVQPNEATFTNAARLAAANEDPDMAFELLKQMKNVAIAPKLRSYEPALFGFCKRGDAEKAYLVDADMVESGIVAEEPELSALLEVSVNAKKEDKVYDILHRLRSTLRQVSESTLGIVEDWFNSEYAAKIGKEKWDVKKVREGIAQGGGGWHGQGWLGSGRWKVANTQVNEDGVCPLCGEKLVSIDIDPKETENFAASLSKLACQKEAKANFVHFQTWLEQHGPFDAVVDGANVGLANGHNFSFSQLNTVVEQLRQISPSKRLPLIILHISRVRGGPAQNPKNMRLIENWKKNGALYATPQGSNDDWYWLYAAVSCKCLLLTNDEMRDHLFQLLGSNFFPRWKEKHQVRTSASTCGHSIIMPPRYSIVIQESANGSWHVPTVTTDDHEIPRKWLCATRSRKDSLHNLWTSSSKSDCT

SEQ ID NO: 56 - protein, 724 aa, Glycine max
MAPFTFTLDFNTLQLQLRHSLFFSKPKLCRVYHPRPSTNIITFSFIQRTQTATKYSSSLEIVTKRAPPASFEPKAGISSTSSSSEVSERVKKKKKKKKNKDKDCPEVKLKNALDMCSKRGDVMGALSLYDSAISEGVKLGQHHYTVLLYLCSSAAVGVVRPAKSGSGARTLNSHVYSNEVPNEGTHFDLDGKAELNSDLNSTEKDEILLVSEDVKRYALQRGFEVYQNMCLDKVQMNEAALTAVARMAMSMGDGDRAFEMVRQMKDLGISPRLRSYGPALFTFCNNGEIDKAFAVEKHMLQHGVYPEEPELEALLRVSVGAGNSDKVYYVLHKLRSIVRKVSPTTSSLIVDWFKSKQASRVGKRKWDERLIREAIENNGGGWHGQGWLGKGKWEAVHTTIGKDGMCKCCQVQLTTIDLDPVETENFAKSVASLAVMREKGSNFQKFQKWLDYSGPFEAVVDAANVGLFGQGRFMPHKINAVANEIRQRLPSKKFPLIILHNKRIKGDKMDEPINRALIDKWNNADALYATPTGSNDDWYWLYAAIKFRCLLVTNDEMRDHLFQLLGNDFFPKWKERHQVRFSFSDTGSPVFHMPPPCSVVIQESEEGHWHIPIDAELNDESERRWLCITRAKLDVVSKDSSTSKDSKPLQKGECARSATRNASAKESQHQNLVNHKEKKETPQELYKNVRDIFLESVSSDKNNSILSDIEAAELIGGCTIDFQI

SEQ ID NO: 57 - protein, 529 aa, Glycine max
MEEHPKKKKKGCRNPETKFQFELNSCSKAKDLRGAISLYDDAVSNNTRLNQHHFNALLYLCSNSVADPSLKPTALDYGFRAFRHMSALAVLPNEATVTAVARLAAAKGDADYAFELVKSMGKNYNNALPRLRTYDPALFCFCEMLDADKAYEVEEHMNGVGVSLEEAELAALLKVSARCGRVDKVYEYLHRLRSSVRCVSESTAVVIEEWFRGSKASEVGEAEFDAGRVKEGVLRNGGGWHGQGWVGKGDWVVSRTSVVADGHCCCCGQQLVCVDIDDVETEKFAGSVAALAFEREVKANFSEFQAWLEKHASYEAIVDGANIGLYQQNFADGGFNISQLDDVVKELYNRSGKKWPLVVLHNKRLRGLMENPSSRRLVEEWMKNGVLYTTPNGSNDDWYWLFAAVKLRCLLVTNDEMRDHIFELIGSNFFNQWKERHQVHYTFVKGNLKLQMPPSYSLVIQESEKGYWHVPLVSGTSCESTRCWLCITRPSGHDAVATVSNGVSSLDSQVDENSATSIAGKRKERSPPS

SEQ ID NO: 58 - protein, 530 aa, Glycine max
MEHSKKKKKKKGSQNPEAKFQFELNTCSKAKDLRGAISLYDDAVSNNTRLNQHHFNALLYLCSNSVADPSLKPTALDYGFRAFCHMSALAVLPNEATVTAVARLAAAKGDADYAFDLVKSMGKNYNNALPRLRTYDPALFCFCEMLDADKAYEVEEHMSGVGVSLEEAEVAALLKVSARCGRADKVYEYLHKLRSSVRCVSESSAVVIEEWFRGSKSSEVGEVEFEAGQVKEGVLRNGGGWHGQGWVGKGDWVVSRTSVGADGHCCCCGEQLVCVDIDDAEREKFAGSVAALAFEREVKANFSEFQAWLEKHASYEAIVDGANIGLYQQNFADGGFSISQLDDVVKELYNRSGKKWPLVVLHNKRLRGLMENPSSRRLVEEWMNNGALYTTPNGSNDDWYWLFAAVKLRCLLVTNDEMRDHIFELIGSNFFNQWKERHQVHYTFVKGNLKLQMPPSYSLVIQESEKGYWHVPLAPGTSCESTRCWLCITRPCGHDVVATVSNGVSSLDSQVDENNATSVTGKRKERSPPS

SEQ ID NO: 59 - protein, 565 aa, Prunus persica
MVGALARTPPLFSSFIKIPLPLISRNSRCIFRTIIHFPKPKLTPTSMDNFSMDKRLHLCTLALSNDSPSRSASAPLVSNKSKKKARRESPEGVLRHKLDMCSRQGHLVEALRIYDEARSRGLPLSLHHYNVLLYLCSSNGGADDDGVGLKRGFEIFRQMVDDKVVPNEATFTSAARLAAAAEDPEMAFHLVKQMKGLGIPPKLRSYGPALFGFCKKGEADRAYEVDAHMVESKVIAEEPEISALLKVSSDSSKGDKVYEMLHRLRISVRQVSESTSGVVEEWFMSEEAANVGMESWDVEKVREGVVRGGGGWHGQGWLGSGNWRVVRTQMDEAGTCSCCGQKLVSIDIDPKETENFATSLNKLASQREVKADFFQFKEWLQKHGPFDAVIDGANVGLINLHNFSFSQLNTLVNRLRQMSPSKRLPLVILHTNRVTGGPAQNPNNKKLLESWKKAGALYATPAGSNDDWYWLYAAVNSKCLLVTNDEMRDHLFQLLGTNFFPRWKEKHQVRMSVSRQGLALHMPPPYSIVIQESEDGRWHVPTTIGDDIETPRQWLCATRATTNTK

SEQ ID NO: 60 - protein, 850 aa, Prunus persica
MASSTSNSLQQKHHLLSINLCKYPSALNSFKFHCPSHFLTFSPPKQTLELKHTLQLYPLPVVRENISHIVAKLSTTYREPYIKTKSPGTGTEFSSLKSTEERVGKKSVKNHVGSVEEKKAEDRFSKDRNTRKNPGFRKRRDDNEHSSRRLKDENKVNFSGKRNDKQAGEEKRGKGSKKYDVDAPEVKMRIGLDMCSKRGDVMGAIKFYDLAQREEIKLEQYHYTVLLYLCSSAAVGVVRPAKSGSGSRTLDTLDSSASEETRVNSMELGSGNWDGRGLNTSTLDTEQLVDTNGSNGEKMGFDDLDGTSDEKENLAWFSNGFVKRNSRLLDGLNYPTKGGDDSSNLKDGSIKQEDNRIRVSEEVKKYALQRGFEIYEKMCLDNVPMNEAALTSVARMAMSMGDGDMAFDMVKQMKSLGINPRLRSYGPALSAFCHSGDIDKAFAVEKHMLDHGVYPEEPELEALLRVSVGVGKGDKVYYMLHKLRTSVRRVSPSTADLIMNWFHSKEAARVGKIKWDPRLIREAIENGGGGWHGQGWLGKGKWSVLRTTIGADGLCKCCGEKLATIDLDPVETENFAESVASIAIKREKNSSFQKFQKWLDYYGPFEAVVDGANVGLFSQKKFIPSKVNAVVNGIRQKLPSKRWPLIVLHNRRISGGKMDERVNRALIEKWQNADALYATPTGSNDDWYWLYAAIKFKCLLVTNDEMRDHIFQLLGNDFFPRWKERHQVHFSFSDAGPVFHMPPPCSVVIQESEEGHWHIPVVSEHDCEAERTWLCIMRSKSRLERNDSATRPEGNSECYQFMKYTKHQPREFFENIKDILSGSMISDCHSIVPDIATAEKIGGCVIDFQI

SEQ ID NO: 61 - protein, 552 aa, Prunus persica
MGTPKKTKKKQTPETQFHSSLTLCSKHKDLPSAISLYESAVSQKTHFNHHHFNTLLYLCSNSVSDPSLKQLALDNGFRVFNQMLSIGTLPNEATITAVARLAAAKGDGDYAFGLVKGMDKYNVLPRLRTCDPALFCFCEKLEAEKAYEVEEHMGMVGVSLEEPEIAALLKVSAETGNGERVYGYLHKLRNVVRCVGESTAKIIEDWFLGGVACELGEANWDSGGVKEAVLRNGGGWHGQGWIGKGVWDVRRANADMSSSQCCSCGERLVCVDIDCGETQRFAESVAALAMEREVKSNFSEFQDWLDKHAEYEAIVDGANIGLYQQNFADGGFSLSQLDAVVKELYNKSGEKWPLVVMHNRRFRGLVENPSHRKLIEEWMDKGILYATPSGSNDDWYWLYAAVKLKCLLVTNDEMRDHIFELLGSSFFLKWKDRHQVRYTFVKGNLQLQMPPPYSSVIQESEIGSWHVPVADDSCQEPARTWLCITRPSVSKASGEVSHNLETSRTGGVCRNLESLNSCTTEFVASHNEKTTVVTGKRKERSPSPSQLNLSSA

SEQ ID NO: 62 - protein, 564 aa, Malus domestica
  misc_feature (30)..(30): Xaa can be any naturally occurring amino acid
  misc_feature (306)..(306): Xaa can be any naturally occurring amino acid
  misc_feature (382)..(382): Xaa can be any naturally occurring amino acid
  misc_feature (506)..(506): Xaa can be any naturally occurring amino acid
  misc_feature (525)..(525): Xaa can be any naturally occurring amino acid
  misc_feature (553)..(553): Xaa can be any naturally occurring amino acid
  misc_feature (559)..(559): Xaa can be any naturally occurring amino acid
MLHGGALPRTSPLFSFFIKIPLPLIFRTSXRFFRPILRSPKPKPTLNSTDSFSMDKRLNLCTLALSDNSPSPSSPAVSNKAMKKARRESPEGVLRHKLDMCSRHGQLVQALSLYDEARSNGVPLSLHHYNVLLYLCSSNGGGDDGDMGLKRGFEIFRQMVEDKVVPNEATFTSAARLAIAGEDPEMAFHLVKQMKGLGFPPKLRSYGPALFEFCKKGEADRAYEVDAHMVESGVVAEEPEITALIKVSSDSSRGDKVYEMLHRLRTTVRQVSESTYGVVEEWFKSEEAAKVGVETWDVNKVREGVXRGGGGWHGQGWLGSGNWRVERTQMDEVGTCSCCGEKLVSIDIDPKETENFATSLSKLASQREVRGDFIRFQEWLQXHGPFDAVVDGANVGLVNQHNFSFFQLDTLVNRLRQMSPSKRLPLVILHQNRVTGGPAQNPNNKRLLESWKKSGALYSTPVGSNDDWYWLYAAVNCKCLLVTNDEMRDHLFQLLGTSFFPRWKEXHQVRLSVSRRGLNLHMPPXYSIVIQEAEDGEWHVPTTTGDDIETPRXWLCATXARNTK

SEQ ID NO: 63 - protein, 821 aa, Malus domestica
  misc_feature (25)..(25): Xaa can be any naturally occurring amino acid
  misc_feature (99)..(99): Xaa can be any naturally occurring amino acid
  misc_feature (171)..(171): Xaa can be any naturally occurring amino acid
  misc_feature (287)..(287): Xaa can be any naturally occurring amino acid
  misc_feature (499)..(499): Xaa can be any naturally occurring amino acid
  misc_feature (512)..(512): Xaa can be any naturally occurring amino acid
  misc_feature (526)..(526): Xaa can be any naturally occurring amino acid
  misc_feature (565)..(565): Xaa can be any naturally occurring amino acid
  misc_feature (584)..(584): Xaa can be any naturally occurring amino acid
  misc_feature (648)..(648): Xaa can be any naturally occurring amino acid
  misc_feature (669)..(669): Xaa can be any naturally occurring amino acid
  misc_feature (686)..(686): Xaa can be any naturally occurring amino acid
MELFQRPHMASFTSNALQQKHHHHXLLSATLCKCPSAFHVFKFRFPSHIFTFSPPKQTLNLYPLPLARQNISHIVAKLSSTTYHEPYTKSQNSGTGSGXEFSSLKSTEQRVSRKPVKNHVGSGVEKNGEDTRKNLVFRKRREGNGPNGPNGPNGHSSRRFRDENAVKSSKXRGSLGVKEGRNKRGGGNQVGGEERRGRGLKKYDADLPEVKMRVGLDMCSKRGDVMGAIRFYDLAQTEEIKLEQYHYTVLLYLCSSAAVGVVRPAKSGSGSRTLDTLDSHSEETRVXSMDTSNLDNEDLDDTCGSNSFDDDSDGTSDENENLAWFSNGFVKRNSRLLDGLNYPTKGGDDSSNVKEGSSKQEDNGIRVSEDVKKYALKRGFEIYEKMCSDNVPVNEAALTSVARMAMSMGDGDMAFDMVRQMKSMGINPRLRSYGPALSAFCHSGDIDKAFAVEKHMLEHGVYPEEPELEALLRVSVGVGKGDKVYYMLHKLRTSVRRVXPSTADLIVKWFLXKEASRVGRTKWDRXSIRDAIENGGGGWHGQGWLGKGKWSVLRTTIGDDGLCKXCGEKLATIDLDPVETENFXESVASIAIKREKNSSFQKFQKWLDYYGPFEAVVDGANVGLFSQKKFVPSKVNAVVNGIRQKLPXKKWPLIVLHNRRITGGRMDEXVNRALIEKWQNADALYXTPTGSNDDWYWLYAAIKFKCLLVTNDEMRDHIFQLLGNDFFPRWKERHQVHFTFSDAGPVFHMPPPCSVVIQESEEGHWHIPVVSEHERESERTWLCIMRAKSRTATKDSAAIPEGDFQGLAICLFLIAQSLLCL

SEQ ID NO: 64 - protein, 553 aa, Malus domestica
  misc_feature (241)..(241): Xaa can be any naturally occurring amino acid
  misc_feature (333)..(333): Xaa can be any naturally occurring amino acid
  misc_feature (346)..(346): Xaa can be any naturally occurring amino acid
MPMGTPKKIKKKQTPEAQFHSSLTLCSKHKDLPTAISLYESAVSQNTRLNHHHFNTLLYLCSNSVADPSIKQLALENGFRMFDHMLSIGVLPNEATITAMARLAAAKGDGDYAFGLVKGMEKYKIFPRLRSYDPALFCFCEKLEAEKAYEVEEHMGMVGVSLEEPEIAALLKVSAETGNGERVYGYLHKLRNAGRCVSESTAKNIEDWFCGGAACEVGEVNWDSVRVKESVLRNGGGWHGXGWIGKGVWDVKRTNVDLSSSQCSSCGERLVCVDLDCAETERFVKSVAALAMEREVKSNFSEFQDWLDKHAEYEAIVDGANIGLYQQNFADGXFSLTQLDAVVKEXYNRSGGKWPLVVMHNRRFRGLVENPSHRKLFEEWMGKGILYATPSGSNDDWYWLYAAVKLKCLLVTNDEMRDHIFELLGSSFFLKWKERHQVRYTFAKGNLKLQMPPAYSSVIQESDNGSWHVPVADESCQEPGRTWLCITRQSVSKACGEVSQKLASSRNGGICDNHELRSCTSDSVASHNDKTTVVTGKRKERTPSPSHLNISPA

SEQ ID NO: 65 - protein, 564 aa, Fragaria vesca
MLHGGAAVTKTPPLFSFFIKIPLPFLSRTSRRFFRPIPHYPKPQPSPISTHTFSMNQRLNNSTLALSRDSPPSPAAPSVSNKARKKARRDLPEAVLKHKLDMCSRHGQVVEALRIYDEARTNGVPLSLHHYNVLLYLCSCDGEDADVGLGRGFEIFRQMVEDKVVPNEATFTNAARLAAASADPEMAFGLVKQMKVFGIEPKLRSYGPALFGFCKKGEAERAYEVDAHMVECGVVAEEAEISALLKISSEMGKGEKVYEMMQRLRSGVRQVGESTAEVVEEWFKSKEAGRVGVERWDVKKVREGVVRGGGGWHGQGWLGSGEWKVVRTQMDEAGTCAGCGQKLVCIDIDPKETEDFALSVTKLANQREVRNDFAQFQEWLQRHGPFDAIVDGANVGLSNQHYFSFIQLNTVVNRLQKLSPANRLPLVILHKSRTIGGPAQTPKNKALLESWKKSRALYATPPGSNDDWYWLYAAVSCKSLLVTNDEMRDHLFQLLGTNFFPRWKEKHQVRVSVSKLGLNLHMPPPYSIVIQESEDGSWHVPTTTGDDIETPRQWLCATRARNTK

SEQ ID NO: 66 - protein, 801 aa, Fragaria vesca
MLLANPYRYRPSKILQGPHMASFTSNSLQQKHHHHHYLLHSITTICKYPSPLNVFEYHCPSHFFTFSPPKQTLQLKHTLKLYPLPLARGNINHIVAKFSTTTTTTTYHEPNSKTLKNSATEKPVKNNGSSVVEKKSEKTRFIKQKSTRKEGVWFKGESKERKKRGSSDGDQVGEEKKGRFSKKNKVKVNVDLPEVKMRVGLDMCSKRGDVMGAIKYYDLAQTEEIQLGQYHYTVLLYLCSSAAVGVVRPAKSGSGGTRTLDTVDSSGEKTVELSKVRDSESGNWDDTSGSDESAEKMEVSPGNRFDDDVDGASNEKRNLAWFSNGFVKRNSRLLDGLNNPTKVGDDGTGLEDGNVKQESNEIRVSEDVKKYALQRGFEIYEKMRLDGVAMNEAALTSVARMAMSMGDGDMAFDMVKQMKSMGINPRLRSYGPALSAFCSSGNIDKAFAVEKHMLEHGVYPEEPELEALLRVSVGARKGDKVYYMLHKLRTSVRRVSPSTADLIVKWFESKEASRVGKTKWDERLIRQGIENGGGGWHGQGWLGKGKWSVLRTTIGSDGLCKCCGGKLATIDLDPVETENFAESVASIAIKREKNSSFQKFQKWLDYYGPFEAVVDGANVGLLSQKIFIPSKVNAVVNGIRQKLPSKRWPLIVLHNRRITGGRMDERVNKALIEKWQNADALYATPTGSNDDWYWLYAAIKFKCLLVTNDEMRDHTFQLLGNDFFPRWKERHQVHFNFSEGGPVFHMPPPCSVVIQESEEGHWHIPVVSEHGYEAERMWLCIMRAKSREARKDSATRPKGNL

SEQ ID NO: 67 - protein, 551 aa, Fragaria vesca
MNKTNLHIGFEIWTLMGTPKRKKKQTPEAQFHSSLTFCSKNKDLSTAISLYESAVSRNTRLNQHHFNTLLYLCSNSVTDPALKQSALEYGFRMFDHMSLTEVVPNEATITAVARLAAAKGDGDYAFELVKGMEKYNVLPRLRTCDPALFCFCEKLEADKAYEMEEHMNKVGVSVEEPEISALLKVSAEMGRGERVYDYLHKLRNTVRCVSESTAKIIEDWYRDGRASEVGEVSWDSGRVKEVVLRNGGGWHGQGWIGKGDWDVQRANVDSESKCCSCGEHLVCVDIDCAETDRFAQSVAALAMEREVRLNFSEFQDWLDKHADYEAIVDGANIGLYQQNFADGGFSLPQLDAVVKELYNRSGEKWPLVVLHNRRFKSLVENPSHRKVVEEWMDKGILYTTPSGSNDDWYWLYAAVKLKCLLVTNDEMRDHIFELLGSSFFLKWKERHQVRYTFIKGNLKLQTPPPYSSVIQESESGSWHVPLADDSCEEPARTWLCITRPSVTKASSGVLISQSALPNSCTSQFVTSHNDKTTTKTGKRKERSPSPSHLMI

SEQ ID NO: 68 - protein, 593 aa, Citrus clementina
MLRGNFLTPSLIRTSPFLTFLSKISLPLMHQSNCHTYRPLLCWHMHSFTKPITDIKQNRFSADLTTGLCTLAFSKKSTVNESSAPNTGTMSNKSKKKARRESPEGVLRHKLDMCSKRGDVFEALRLYDDARSNGITLSQHHYNVLLYVCSCKCGSESSENGDRETDLNLGLKRGFEIFQQMITDKVDPNEATFTSVARLAVAKEDPEMAFDLVKQMKSFGIPPKLRSYGPALFGFCKLGNTDKAYEVDAHMGESGVVPEEPELSALLKLSVDAKKVDKVYEILHRLRTLVRQVSESTFKIIEDWFDSVDAAEIGVLNWDVSKVREGIVRGGGGWHGQGWLGSGKWRVERTQIDENGVCCSCNERLVCIDIDPRETENFASSLSNLACQREVRSDFNKFQEWLGRHGPFDAVIDGANVGLVNQHNFSFYQLNTVVNRLRQMSPSKRMPLVILHKGRVSGGPAQIPKNKKLLDIWRDGGALYTTPPGSNDDWYWLYAAVNCKSLLVTNDEMRDHLFQLLGTSFFPRWKEKHQIRLSVSRDGLNLLMPPPYSIVIQESENGSWHVPVITGDDLEAPRQWLCATRARVKSLHSLFSN

SEQ ID NO: 69 - protein, 874 aa, Citrus clementina
MASSLTVNTLQQQNQLFSLTLCKSSPPTLTVFNFQFLSRFLSSSPPKRTPLLVFKAHVRNTQAKLSTTETEHETSTVTLRTRKGTASGASSLGTRDKRVDSAGEEKDGKRLTKDNNSRKNFAFLKSREMSSGNSSLRSKDKKIGIKSSKTVNREVDNQKMEQRTNDSGQYKVRGITDEKGSKKSKKDRSEQFQLRVELDMCSKRGDVMGAIRLYDKAQREGIKLGQYHYNVLLYLCSSAAVGVVKPAKSGSGMRTLDTFEVSTMNSTELGDSRDMDNNGQLDYGSSPMIDKLESNSSYRFDDLDSTFNEKENLGQFSNGHMKLNSQLLDGRSNLERGPDDQSRKKDWSIDNQDADEIRLSEDAKKYAFQRGFEIYEKMCLDEVPMNEASLTAVGRMAMSMSDGDMAFDMVKRMKSLGINPRLRSYGPALSVFCNNGDVDKACSVEEHMLEHGVYPEEPELEALLRVSVEAGKGDRVYYLLHKLRTSVRKVSPSTADVIAKWFNSKEAARLGKKKWNESLIRDKMENKGGGWHGLGWLGKGKWIVSHTTVGGDALCKCCGEKLAIIDLDPIETEKFAESVASIAIKRERNSSFQKFQKWLDYYGPFEAVVDAANVGLYSQRNFKPARVNAVVNGIRQKFPSKKWPLIVLHNRRITGHKMDQPVNRALIEKWKNADALYATPTGSNDDWYWLYAAIKFKCLLVTNDEMRDHTFQLLGNDFFPRWKERHQVRFSFSDAGPEFYMPPPCSVVIQESEKGNWHIPIASKQDYDDEERRWLCVTRANSHMNRQNSYSSPKDLQPLDHNKGQASSSTRADAKTKSHSSNDSPSVNTKRPARKMYKNLKNILSASVLSNHQSVLSKIEAAEELGDCVIDFEI

SEQ ID NO: 70 - protein, 501 aa, Citrus clementina
MSNTTSTNPSKPNKKRKTNPNPETNFLINLQSCTKSKDLTTAISLYESAHSQNLRLSLHHFNALLYLCSDSATDPSSKDSALRHGFRVFDQMLSNNVIPNEASVTSVARLAASKNDGDYAFVLIKRMNNEFNVVPRLRTYDPALFCFCENLEAEKAYEVEEHMGLMGLSLEQQEIAALLKVSAETGRVEKVYQYLQKLRSTVRCVNEETGKIIEDWFSGQKVNGVSCDLGLVKNAVLKNGGGWHGLGWIGQGKWVVKRGSVDESGKCCSCGDQLACVDIDDAETERFAQSVAALAMEREVKANFSEFQDWLEKNANYEAIVDGANIGLYQQNFTEGGFSVPQLDAVVKKLYERSGNKWPLVILHNKRLRSLWENPSHRNLVEEWNEKGVLYMTPHGSNDDWYWLYAAVKLRCLLVTNDEMRDHIFELLGSNFFLKWKERHQVHYTFVKGNLKLQMPPPYSSVIQESEKGSWHVPILVKGNSSQTWLCITRPNVCESRDEAQ

SEQ ID NO: 71 - protein, 593 aa, Citrus sinensis
MLRGNFLTPSLIRTSPFLTFLSKISLPLMHQSNCHTYRSLLCWHMHSFTKPITDIKQNRFSADLTTGLCTLAFSKKSTVNESSAPNTGTMSNKSKKKARRESPEGVLRHKLDMCSKRGDVFEALRLYDDARSNGITLSQHHYNVLLYVCSCKCGSESSENGDRENDSNLGLKRGFEIFQQMITDKVDPNEATFTSVARLAVAKEDPEMAFDLVKQMKSFGIPPKLRSYGPALFGFCKLGNTDKAYEVDAHMGESGVVPEEPELSALLKLSVDAKKVDKVYEILHRLRTLVRQVSESTFKIIEDWFDSVDAAEIGVLNWDVSKVREGIVRGGGGWHGQGWLGSGKWRVERTQIDENGVCCSCNERLVCIDIDPRETENFASSLSNLACQREVRSDFNKFQEWLGRHGPFDAVIDGANVGLVNQHNFSFYQLNTVVNRLRQMSPSKRMPLVILHKGRVSGGPAQIPKNKKLLDIWRDGGALYTTPPGSNDDWYWLYATVNCKSLLVTNDEMRDHLFQLLGTSFFPRWKEKHQIRLSVSRDGLNLLMPPPYSIVIQESENGSWHVPVITGDDLEAPRQWLCATRARVKSLHSLFSN

SEQ ID NO: 72 - protein, 874 aa, Citrus sinensis
MASSLTVNTLQQQNQLFSLTLCKSSPPTLTVFNFQFLSRFLSSSPPKRTPLLVFKAHVRNTQAKLSTTETEHETSTVTLRTRKGTASGASSLGTRDKRVDSAGEEKDGKRLTKDNNSRKNFAFLKSREMSSGNSSLRSKDKKIGIKSSKTVNREVDNQKMEQRTNDSGQYKVRGITDEKGSKKSKKDRSEQFQLRVELDMCSKRGDVMGAIRLYDKAQREGIKLGQYHYNVLLYLCSSAAVGVVKPAKSGSGMRTLDTFEVSTMNSTELGDSRDMDNNGQLDYGSSPMIDKLESNSSYRFDDLDSTFNEKENLGQFSNGHMKLNSQLLDGRSNLERGPDDQSRKKDWSIDNQDADEIRLSEDAKKYAFQRGFEIYEKMCLDEVPMNEASLTAVGRMAMSMGDGDMAFDMVKRMKSLGINPRLRSYGPALSVFCNNGDVDKACSVEEHMLEHGVYPEEPELEALLRVSVEAGKGDRVYYLLHKLRTSVRKVSPSTADVIAKWFNSKEAARLGKKKWNESLIKDTMENKGGGWHGLGWLGKGKWIVSHTTVGGDALCKCCGEKLAIIDLDPIETEKFAESVASIAIKRERNSSFQKFQKWLDYYGPFEAVVDAANVGLYSQRNFKPARVNAVVNGIRQKFPSKKWPLIVLHNRRITGHKMDQPVNRALIEKWKNADALYATPTGSNDDWYWLYAAIKFKCLLVTNDEMRDHTFQLLGNDFFPRWKERHQVRFSFSDAGPEFYMPPPCSVVIQESEKGNWHIPIASKQDYDDEERRWLCVTRANSHMNRQNSYSSPKDLQPLDHNKGQASSSTRADAKTKSHSSNDSPSVNTKRPARKMYKNLKNILSASVLSNHQSVLSKIEAAEELGDCVIDFEI

SEQ ID NO: 73 - protein, 501 aa, Citrus sinensis; identical to SEQ ID NO: 70

SEQ ID NO: 74 - protein, 581 aa, Populus trichocarpa
MLLCRSSTFFAPSFNAKTSQNFCSYFTKKTHLLSFFKNSPICCNHSYLFAKHIKDSNFIGAHNLFMKKKATFCNSAISATSQSDEKAVGGNVVSKRLKKKARRDAPEGVLRFKLDMCSKVGDVVEGLRLYDEARRNGVELNQHHYNVMLYLCSQNRGENGSDLKLACKRGFEIFQQMIIDKVPPNEATFTNAARLASVMEDPEMAFDLVKQMKGFGIMPKLRSYGPPLFGFCKKGMVDKAYEVDAHMIESGVVAEEPELSSLLKLSADVNNADKMYELLHRLRTSVRQVMESTVGVIEDWFKSEHAAKIGKGDWDVIKVKEGVVRGGGGWHGQGWLGHGQWRVVRTQMDKKGVCGSCGERLACIDIDPRETENFAISLSKLAFGREVKADFIQFQEWLQQHGPFDAVVDGANVSLINQQTFNFSQLNNVVNRLHDMSPSKKFPLVILHKSRVNGGPAQSPYNKKLLERWKNSGALYATPAGSNDDWYWLYAAVSCKCLLVTNDEMRDHLFQLLGTSFFPRWKEKHQVRLSVSRSGIALHMPPPYSIVIQESENGGWHVPTTTGDDLETPRQWLCATRPVKR

SEQ ID NO: 75 - protein, 578 aa, Populus trichocarpa
MLLCRRSTIFVPSFIAKTSPNLFSYFTKKTHALSLFKNSPIRCNHSYLFGKPIKDSNFIGAHDLFVNKKAKFCNLAISGTSRRNEKAVGGNVMSLREKKKARREAPEGVLKFKLDTCSKRGDVVEGLRLYDEARKNGVELNQHHYNVLLYLCSQNGGENVSDLRKQGFEIFQQMIIDKVPPNEATFTNAARLASAMEDPEMAFDLVKQMKGFGILPKLRSYGPPLFGFCKKGMADKAYEVDAHMIEYGVVAEEPELSALLKVSADVNNADKVYELLHRLRTSVRQATESTVGIIEDWFKSKHAAKTGKENWDVRKVKEGVARGGGGWHGQGWLGCGQWRVVRTQMDKEGVCGSCGERLACIDIDPRETEDFAISLSKLALGREVKADFIRFQDWLQRHGPFDAVVDGANLSLINQQTFSFSQLNSVVHRLHDMSPSKKLPLVILHKSRVTGGPAQSPYNKKLLERWKNSGALYVTPAGSNDDWYWLYAAVCYKCLLVTNDEMRDHLFQLLGTSFFPRWKEKHQVRLSVSRSGIALQMPPPYSIVIQESENGSWHVPTTTNDDLETPRQWLCATRPIKS

SEQ ID NO: 76 - protein, 759 aa, Populus trichocarpa
MACFTSNILQQKHVLSITLCKYPSPSLHACKFHFLSHIPGSSPPKHTPLLVATTLASNILHAKLSATDHDSPTKTINSRTRKENNALGFPSSRRIAKRVERKHVKNLTTSVVDEKTEKRFSKDRNTRKNMGFRESTGMGSENCTKDGKKGIRFLATMDSQGVCGEMESRTKNGSDIQVIKVDKIGKGSKQDKVDSSELKLRVRLDMCSKRGDVIAAIQLYDLAQREGIKMGQYHYAVLLYLCSSAAFSEDVKKYALQRGCEIFEKMCKEKVPINEATLTAVARMAMSIGNGDLAFEMVKQMDALGINPKLRSYGPALSVFCSSGDIDKAFYVEKHMLEHGVYPEEPELKALLRVSVEGGKGDKVYYLLHKLRRIVRRVSPSTAGIIVRWFNSKAASRVGKTKWDVKEAIENGGGGWHGQGWLGKGKWTVSCTSVGLDGICKYCGQKLTTIDLDAVETEKFAESVASIAIKRDRDSSFQRFQKWLDYYGPFEAVIDGANAGIYNQGRFMPSKINAVVNGIRQKLPSKKWPLIVLHNKRITGRKMDGPVNKAFIEKWKNADALYATPTGSNDDWYWLYAAIKFKCLIVTNDEMRDHTFHLLGNDFFPRWKERHQVHFRFTDAGPDFDMPPPCSVVIQESEKGHWHIPIETEGEGEGEAEREWLCITRANSRTTRHSITTTPGGSQSVGHGKKQARSSMQTRVAIKPDRLKHNIPDNIRKPPQDYKNLKDILAASGFPDHRTVLSEIETAEELGDTVIDFQI

SEQ ID NO: 77 - protein, 570 aa, Populus trichocarpa
MAMASSSNKKKPKKNQTPESQFNYNLNFYSKSKDLHSAISLYDTAISQDTRLNQHGFNTLLYLCSVSLNDPSTEELALRCGLRIFDHMVSNGIKPNEASITAVARLAAAKGDGDYAFDLVKNVGAYNELPRLRTYDPALFCFCEKLEAHKAYEVEEHMGSMGVGLEEGEIAALLKVSVESRNEKRVYGYLQKLRKMLRCVRGETAKVIEHWFAVFEGSGVELDVDLVREAVSRNGGGWHGLGWIGKGKWVLKRGSVDVGGKCCCCGEQLVSVDIDDDETERFAESVAGLAMQREVKANFSEFQNWLEEHANYEAIVDGANIGLYQQNFAEGGFSISQQLDAVVKDLYNQSGKKWPLIIMHNKRLRALLQNPSTRELIQEWIEKDVLYTTPQGSNDDWYWLYAAVKLRCLLVTNDEMRDHIFELLGSDFFIKWKERHQVRYTFVKGKLELQMPPLFSVVIQESENGSWHVPVAGNGNDSPQSWLCVSRPRACDALEEDSCMEGSKDSNDICCNSKLLSFGRPESLTSCKNKLQSQASFQESDNKITALTCKRKERSPSPSYLHVPCDQRHQ

SEQ ID NO: 78 - protein, 558 aa, Populus trichocarpa
MAMASPANKKKPKSNQTPESQFSYNLNFYSKSKDLHSAISLYDTAISQNTRLNQHNFNTLLYLCSISLNDPSTKDLSLQYGFRVFDHMVSNGIKPNEASITAVARLAAAKGDGDYAFDLVKNIGVYNELPRLRTYDPALFCYCEKLEGDKAYEVEEHMRRIGVGLEEGEIAALLKVSVETRREERVYGYLQKLRKMVRCVREETAKVIEHWFEVFEGNGVELDVGLVREAVSRNGGGWHGLGWIGKEKWVVRRGSVNAGGKCCCCGEQLVSVDIDDDETERFAESVAGLAMEREVKANFSEFQNWLEKHANYEAIMDGANIGLYQQNFAEGGFSFSQLDAVIKDLYNQSGKKQPLIILHNKRLRALLQNPSTRELIQEWIEKDVLYTTPHGSNDDWYWLYAAVKLRCWLVTNDEMRDHIFELLGSDFFVKWKERHQVRYTFVKGNLELQMPPLFSIVIQESENGSWHVPVAGDGNDSPQSWLCVSRPSSCDALKEASCMEESKDSNDSRCNSKLPTFGRPESLASCKHKLHSRDSFQESDDKITALTGKRKERSPSPS

SEQ ID NO: 79 - protein, 584 aa, Eucalyptus
MELAKRFPVLSFIMKSEIPLLLKYRKRFLPLPCSPSSFITRTVNSYPFNPHSMKRINRLTTSSNLNPLPPLHQTSGEKVSRKAKKKERMELPESLLKFKLDMCSRHGKLVEALQLYDEARENGVPLSHYHYNVMLYLCSSAGSGSLGQGGSENDENLKELGMRRGFEIFRQMAIDNVAPNEATFTNAARLATAREDPEMAFDLVKKMKNFGIPPRLRSYGPALFGFCKKGNADKAYEVDEHMVDCGVLAEESELSALLKVSMDAKKADKVYELLHRIRATVRQVSESSAQIVEDWFKSDFAASVGVESWDINKIKEGVVKGGGGWHGQGWLGSGNWRIRRTQMDKKGVCQSCGEKLVCIDIDPKETENFASSLTKLAREKEAKAGFTKFQAWIQKHGPFDAVVDGANAGLVNQKRFNFFQVNFIMNKLREMSPSKRFPLLILHKRRVHGKPDKDPRNQKLLETWENSGALYPTPLGSDDDWYWLYAAVHWNCLLVTNDEMRDHLFQLLGSSFFPRWKEKHQVRISVSKRGIQLHKPPPYSIVIQESENGNWHVPTVTGDDLETPRQWLCATRSKNVSNPLLNLF

SEQ ID NO: 80 - protein, 675 aa, Eucalyptus
MYSKSGDFLGAVQWYDSARKEGIQLGQYHYAVLLYLCASAAVGVVQPAKSGSGARTLNRLDLLNEDVTTNRVKFGEEDEVVSNDLLSIGARGIEGNAGKMDLRSNRTNGNVEYTDEIKSIRQNFNGFPKPNAHVSDRLNDVGKTKGDSSDIENEAIDQEDQVVIFDENLKKFAVEKGFEIYREMCSDKVPMNEATLTSVARMAMSIGDGDMAFDMVKQMKPMGINPRLRSYGPALSTFCNSGDIEKAFEVENHMLKNGVYPEEPELQALLRLSIAVGRGDKVYYLLHKLRTSVRKVSPYTADLIEDWFKGKVASRLGKRKWDERDIREAIKNHGGGWHGKGWLGRGKWSVSRASVGSDGSCKCCGEKLATIDLDPWETEKFAKSVAALALKREKNSSFQKFQKWLDYFGPFEAVIDGANAGLFSQQRFLPAKVNAVVNGIRQKLPLRRWPLIILHNRHITGKKMEVPVNRAIIDKWRNKDALYLTPTGSNDDWYWLYAAIKFKCLIVTNDEMRDHTFQLLGNDFFPKWKERHQVRFSFSDAGPEFHMPPPCSVVIQESENGHWHIPILLEHEYEADRTWLCVTRASSGLATRPEDLQLHQWSEQHVMEDKDPQDGVDPFSETLQPNHDNVRKSPPETHQNLKNIFAAAVSSYDSTLLSELDTAERCGNCIIDFQI

SEQ ID NO: 81 - protein, 574 aa, Eucalyptus
MAAPHPSTHLKSQKKSRKNQTPEANFQVALNSLSKTRDLPGAIALYEGAAASRGVRLNQHHFNALLYICSNAVAEASLKESALDHGFRIHAHMESCGVAPSEATVTAVARLAAARGDGDYAFGLVRKMGERGIAPRLRTYDPALYCFCGALEADKAYEVEEHMRSAGLSLEEPELSALLRVSAETGREERVYEYLHKLRDCVRWVSEETAVSIESWFSGEKAVGVGDVNYDRSHVKDVVLRNGGGFHGLGWIGKGNWVVRRGNVDENGVCSCCGERLACVDIDDMETESFASSIAALACERESKANFSDFQDWLEKHADYEAIVDGANIGLYQQNFADGGFSVPQLDAVVKELYGRSKGKWPLVILHNKRLKGLLESSPHKQLLQEWIDKGVLYTTPSGSNDDWYWLYAAVRLRCLLLTNDEMRDHIFELLGSKFFSKWKERHQVRYTFVKGSPVLIMPLPFSPVIQESETGSWHVPVKDDSNEEIVRTWVCITRPSVCKSSNGVLASKESPEGSNNFLNDHKLLNSSKPGTTTEDSNALGSIGFSQDCVNNTNIMTRKRKERSSSPPPLASSS

SEQ ID NO: 82 - protein, 589 aa, Ricinus communis
MLRGSSFAPSLNRASPLFSFFTKIPFFSSFQNNFHTIRRPFLHYHYYVFPKPVCNIQASRFCMERRVQFCSSALSAKPQIHESSALAAKKVSNKAKKKARQESPEGVLRSKIDNCSKHGNLVEALRLYDEARINGVQLNQHHYNVLLYLCSSGSSVELGGNGANEKASNMQFKRGFEIFQQMVIDKVPPNEATFTNAARLAIAMEDPEMAFDLIKQMKCFDILPKLRSYGPALFGFCKKGMADRAYAVDAHMAESGVMPEEPELSALLKLSVDIKRADKVYEMLHRLRATVRQVTETTIDIIEAWFKSEDASKIGEEKWDVSKVREGVVRGGGGWHGQGWLGSGQWRVVRTQIDAKAVCNSCSEKLVCIDIDPSETENFATSLTNLACQREVKADFVRFQEWLQKHGPFDAVIDGANLGLINQTNFSFRQLNTVVSKLRQMSPSKRLPLIILHRSRVTGGPAQNPNNMKLLEFWKKSGALYATPTGSNDDWYWLYAAVSCNCLLVTNDEMRDHLFQLLGTSFFPRWKEKHQVRLSVSRSGIALHMPPPYSIVIQESENGSWHVPTISEDDLETPRQWLCASRTRNKVVL

SEQ ID NO: 83 - protein, 745 aa, Ricinus communis
MSTRYKGATKERKYMDNQLISGRMEKKPRKGSDNKVKEEKSGKWSKRNKGDPQEVKFRLELDKCCKRGDVMAAIQLYDLAQREGIKMGQYHYTVLLYLCSSAAAGVVQPGKSGRGGRASNSLAVSDEVSSASVVEFRELRDKNDVDATESDTKILNNVNKVIDSGRNPGSKDKMELKSSNRFNDSDSTSNERKNLSQIPIVVSDSNYQQLECLSFPAKNNDGKYHDGNGILVSEDIKKYALERGFEIYEKMCMDKIPMNEATLTAVARIAMSMGNGDMAFDMVKQMKLLGLNPRLRSYGPALAAFCSSGDADKAFTVEKHMLDHGVHPEEPELEALLRVSVEAGKGDKVYYLLHKLRTSVRKVSPSTANIIIEWFKSKAASRVGKTKWDKRVVKEAIANGGGGWHGQGWLGKGKWTVSCSSVGVDAFCKSCGKKLATIDLDPTETESFAESVASIAIKREKDSSFQKFQKWLDYYGPFEAVVDGANVGLLGQKRFIPSKINAIANGIRQKLPSKKWPLIVLHNRRVTGHKMDEPVNKSLVEKWKHADALYATPTGSNDDWYWLYAAIKFKCLIVTNDEMRDHTFQLLGNDFFPKWKERHQVHFGFSDAGPVFHMPPSFSVVIQESENGHWHIPIASDTDYEPERAWLCITRAKLPLPRKDSITIKPEESQFVKRSSGQAKLPTKTRVKAKQGTLNHGSDEDNSPEQVYKNLRNILSASGFTDHRTVLSEIEAAEKLGDSVIDFQI

SEQ ID NO: 84 - protein, 561 aa, Ricinus communis
MATGTTTTAPVGKKKPNKKNQTPESQFNYNLNFYSKSKDLNSAISLYKTAISNKTQLNQHHYNTLLYLCSISLNDPSEKELALQNGFDIFEHMVATGIKRNEASITAIARLAAAKGDGDYAFNLIKNMLVDNQLPRLRTYDPVLFCFCEKLEAFKAYEVEDHIVSMGMNLEELEIAALLKVSVETKNKERVYGYLQKLRKTVRCVKEETAKIVEDWFKDFEVNGKELDVGLVRKAVVKNGGGWHGLGWIEKGKWGVKRGNMDMDGRCCCCGESLACVDIDDLETERFAGSLAGLAMEREVKANFSEFQDWLDKNADYDAIVDGANVGLYQQNFAEGGFSISQLDAVVKELYDRSGKWPLIVLHNKRVRAILENPSQRNLIQEWTEKDILYTTPHGSNDDWYWLYAAVKLKCLLVTNDEMRDHIFELLGSSFFLKWKERHQVRYTFVKGKLKLQMPPPFSVLIQESEKGSWHVPIAGDGNEDSAQSWLCITRSSACYAPDKDEMNIETFETEYQDRILLSPSKANSITGYNDILDSEESFPHSENKPATPTGKRKGRSTSPS

SEQ ID NO: 85 - protein, 558 aa, Medicago sativa
MLRGTVSMAKRTPLFSILTHRPFLSSFSLKHTFNRATLPFTTTTINNTLSQTPTSQNNTESTTHPIKLSTKARRKAAQESPVGILQKKLNNCSKTSDVLQALNLYDEARKAHVPLNLDHYNKLLYLCTVQNGDGSFFHLGLQRGFEIFEQMLRDNVEPNEATFTNAARLAAAKEDPEMAFELLKQMKRVGIAPKLRSYGPALYGFCARGDAMKAYEVDDDMIESGVMAEEDELCALLEVSVEVKNEDKVYEILHRLRAVVRQVSESTLKVIEDWFESEYAMKIGKREWDDEEIREGFVRGGGGWHGQGWLGSGEWKVVKTNVDEDGMCLSCSEKLVSIDIDPKETENFAASLSKLAHEKQPKANFNHFQKWLEKNGPFDAVVDGANVGLANIAEFSFKQLDYVVRQLRQLSPSKRLPLIILHVNRVTGGPAQNPNNKRLIENWKKNGVLYATPHGSNDDWYWLYAAVSCKCLLLTNDEMRDHLFQLLGSSFFPRWKEKHQVRVSVSTRGASLVLPPRYSLVIQESANGSWHVPTVVSDEPDIPRKWLCVTRSRKKLIT

SEQ ID NO: 86 - protein, 479 aa, Medicago sativa
MHRDKRNGIMVSEVVKEYALQRGFEVYENMRMSKVEMNEAALTSVARMAMALSDGDKAFEMVKQMKILGINPRLRSYGPALSTYCNNGEIDKAFDVEKHMLEHGVYPEEPELEALLRVSIRGGKSDRVYYVLHKLRSSVRKVSTTTADLIVDWFKSKIALKVGKRKWDNGLIMKAMQNNGGGWHGTGWLGKGKWQVLQTSVRKDGMCKCCGVQLATIDLDPVETENFAKSVASIAISNEKNSNFQTFQKWLDYYGPFEAVIDAANINAVVNELRQKLPSKKFPLIVLHHRRIKGDKRDVPINKALVDRWNNANVLYATPTGSNDDWYWLYAAIKFKCLLVSNDEMRDHLFQLLGNDFFPKWKERHQVRFGFSDAGLEFYMPPPCSVVIQESEEGHWHIPIEAELNDEAERRWLCITRAKLDMVSGDSSTTSKDEKPLQNGEQAKSVTRKESAKELQYQNLVNHKKMIGTPQESYKNHRK

SEQ ID NO: 87 - protein, 482 aa, Medicago sativa
MNDKDRDKRNGIMVSEVVKEYALQRGFEVYENMRMSKVEMNEAALTSVARMAMALSDGDKAFEMVKQMKILGINPRLRSYGPALSTYCNNGEIDKAFDVEKHMLEHGVYPEEPELEALLRVSIRGGKSDRVYYVLHKLRSSVRKVSTTTADLIVDWFKSKIALKVGKRKWDNGLIMKAMQNNGGGWHGTGWLGKGKWQVLQTSVRKDGMCKCCGVQLATIDLDPVETENFAKSVASIAISNEKNSNFQTFQKWLDYYGPFEAVIDAANINAVVNELRQKLPSKKFPLIVLHHRRIKGDKRDVPINKALVDRWNNANVLYATPTGSNDDWYWLYAAIKFKCLLVSNDEMRDHLFQLLGNDFFPKWKERHQVRFGFSDAGLEFYMPPPCSVVIQESEEGHWHIPIEAELNDEAERRWLCITRAKLDMVSGDSSTTSKDEKPLQNGEQAKSVTRKESAKELQYQNLVNHKKMIGTPQESYKNHRK

SEQ ID NO: 88 - protein, 435 aa, Lotus
MLYLCSIPHSDSMDSGQVGLERGFEIFQQMMREKVKPNEATFTNAARLAAAKEDPQMAFELLKQMKDVGIAPKLRSYGPALFGFCKRGEFEKACEVDADMIESGLVAEEPELSALLEVSVSAKKEDKVYEILHRLRATVRQVSESSLQIIEDWFNSEYAMKVGEENWDADKVRDGIVRGGGGWHGQGWLGSGQWKVVKTHVNEDGMCLSCGEKLVSIDLDPKETENFATSLSKLACQRETQSNFNNFQKWLKQHGPFDAVVDGANVGLANQHNFSFSQLNNVVKQLRQISPSKRLPLIILHVSRVTGGPAQNPNNKRLLEHWRENGALYATPQGSNDDWFWLYAAVSCKCLLLTNDEMRDHLFQLLGSNFFPRWKEKHIRVSASAGRVSLVMPPRYSIVIQESANGSWHVPTVTSDDDHEIPRKWLCATRSSNKS

SEQ ID NO: 89 - protein, 487 aa, Lotus
MKLKIAFDMCSKRGDIMEALSLYDAARSEGLKLQQHHYTVLLYLCSSAAVGVVQPAKSGSGARTLNAQVELVNHEDNDNSVSVDRNERDFSNGILVSGDVKKYALKRGLEVYESMSQSKVKMNEASLTSVARMAMAIGDGDMAFEMVKQMKSLGINPRLRSYGPALSTFCNNGEIDKAFAVEKHMLEHGVCPEEPELEALLRVSNSIRAGKGDKVYYVLQKLRTSVRKVSPSTAQLIIDWFKSTQASRVGKRKWDKKLIMEAIENHGGGWHGQGWLGKGKWRVVHTAIGNDGICKCCGVHLATMIKWLDYYGPFEAVVDGANVALFGQGRFIPSKINAVVNGIRQKLPSKKFPLIILHNRRIKGDKGGEAINGALIDRWNNADALYATPTGSNDDWYWLYVAIKFKCLIITNDEMRDHLFQLLGNDFFPKWKERHQVHFSISDTGPEFYMPPPCSVVIQESEEGHWHIPIETELSNESERRWLCITR

SEQ ID NO: 90 - protein, 616 aa, Aquilegia
MQKNLFKQFRFNNILNPLKATKMTFSSHLSPSYLLKNSSFFNFFIKTHSILSNNTNNRALLHLLQYPSLLSSKPIIKNNFFNLSTNKKHYLCTSTASAISHNRNSSTPNVRTPSKRAQNKAQRQSPEGQLRYKLDMCSKDGDLVEALRIYDDARSNKFSLSKHHYNVLLYLCSSSDVLVQENVFNQKDEKSRNLGLRRGFEIFKQMGIDGIAPDEATFTNASRLAAKMEDPEMAFELLKKMMNSNIPPKLRSYEPALFGFCNKGEANKAYEVDAHMLASGVTPEEPQLVALLRVSVNVKNADKVYEIIHRLRASVRQVSDSTAKIIEEWFKSKEAMEVGKESWDVNKVKEGIVKGGGGWHGQGWLGKGEWKVVKTEMDENGVCHCCGERLVCIDIDPLETENFANLLSRLACQREAWANFNQFQNWLKNNGPFDAVIDGANVSLNNGHAFSFFQLNAVVERVREFSPTKRLPLIILHTGRVVGGPANSPKNKALIEQWRRFGALYTAPKGSNDDWYWLYAAVNCKSLLVTNDEMRDHLFQLLGTSFFPRWKEKHQVRYKVSRDGTVLQLPPPYSIVIQESERGGWHIPIASADDVDTPRQWVCASRASTSLNSAIS

SEQ ID NO: 91 - protein, 822 aa, Aquilegia
MATMSTTTTTAFNTLQQKHLFSMTLCKYPSSLSFTSTCFISHFFKFHQEFTSLKTLKETFCSNNNNVIMCSLEHQHSIKTLNPTTQKEYNYGFFPLKSRDERVGRKAKVSSIVGEKTGKKYRKDVDSRRKREMGSGVSSLGSVEERVEIKSKVADKVVDEKMTKFSKKSNGSSKLRNETSNKNSSGSNADFQVGEGKSRKRRKKEKVETPEFKLKAGLDMCSKRGDLLSAISLYDTAQKEGVKLGQYHYTVLLYLCSSAAVGVIRPAKSGSGSRTSDKLDLMNEVPNENVHVRLDPSTSSHGYPIDSSSESHVLSSNKVQEINNSELEPVKYVIPLGNKTERLANKLFDKTSNTSNGFYTGIDQEDSDREREGNSNQEDHKIQVSEDVKKYALVRGFEIYENLCLEKIPLNEATLTSVARMAMSMGNGDMALEMVNKMKEMGINPRLRSYGPALFTFCKTGDIDNAFMVEEHMLENGVYPEEPELEALLRLSVEAGRGDKVYYLLHKVRNSIRKVSPSTADLIERWFRSKPASTVGERNWDHRLIMEAMENGGGGWHGQGWLGKGRWNSARTFIGTDGVCESCGDKLVTIDLDPTETENFAKSVASIAAKRERKSCFQNFQKWLDYYGPFEAVVDAANVGLYSQRHFSTSKVNAIVNGIRQKLPSKKWPLIVLHNKRITGGRMDEPANKTLVEKWKNADALYATPTGSNDDWYWLYAAIKFKCLLVTNDEMRDHIFQLLGNDFFPRWKERHQVHFNFSDSGPEFIMPPPCSVVIQESEKGHWHIPIESEVASERERTWLCVTRSDPERPGSPKKHKGIYSEE

SEQ ID NO: 92 - protein, 547 aa, Aquilegia
MENSNQTNQSKKRKKTLNLEGQFMYDLGTCSKSNDLAGALSLYEKAISQNLRLNHNHLNTLLYLCSNSLHDLASKDSAIEKGFGIYERMIANNINPTEATITAVARLAAANGDGDFAFELVKSMGKYKIVPRLRTFDPALFAFCEKLEAEKAYEVEELMVSMGIHLEEPEFAVLLKVSSEVGREDKVYLYLHKVRNCTRCVSLVTGEIIESWFNKGLASEVGVSEWDENGIKDAMLKNGGGWHGQGWLGKGKWVVSKSNINLEGCCCSCGERLVCVDIDRAETEKFAESVASLATKREAKSDFRVFQEWLDNHSGYEAIVDGANVSLYQQNFADGGFSISQLEAVVKDLYDRSGKWPLVIMHNKRVSSLMDNPSNLKILEDWKNQGTLYTTPNGSNDDWYWLYAAVKLKCLLVTNDEMRDHIFELFGSNFFLKWKERHRVRFTFLKNNLRLLMPPSYSLVIQESEKGSWHVPIDGECNDELLRTWLCITRPRLHDYSSEVLKSSHSLVLDRPFSNHMSTMNGSHNNESKALSGKRKSRSPSPSKGHP

SEQ ID NO: 93 - protein, 572 aa, Eutrema halophila
MLRATCFTPSLSRACRPLFVMILRIPSVHLPHHRSFSPFRGYHTSLPVKGTRDRRLLLVEHKRHLCTMPVAAKQSQASPSENLSRKARKKAIQQSPETLLKQKLDMCSRNGDAVEALRLYDEAKRNGVQLSQYHYNVLLYVCSLSEAGTESSPNPGLSRGFDIFKQMIVEKVVPNEATFTNGARLAVAKDDPEMAFDMVKQMKAFGIQPKLRSYGPALFGFCRKGDADKAYEVDAHMLESEVVPEEPELTALLRVSMDIKNTDKVYETLQRLRDLVRQVSKPTFDTIEEWFNSEAAAKAGVEKWDLKKIKDGVVSGGGGWHGQGWLGTGKWNVTRTEMDENGVCKCCKDKLVCIDINPVETENFAASLTRLACEKEVKSNFNQFQEWLQRHGPFDAVIDGANMGLVNQRSFSFFQLNNVVQRFQQNSPSKRLPLVILHKSRVIGGPATYPKNRALLEKWKNAGALYATPPGSNDDWYWLYAAVSCKCLLVTNDEMRDHLFQLLGNSFFPRWKEKHQVRISVSREDGLTLHMPPPYSIIIQESEDGTWHVPMSVKDDLQTSRQWLCARRSKTH

SEQ ID NO: 94 - protein, 555 aa, Eutrema halophila
MAASDQRRSRQEEGSPSKPNKKKKANRNPETNLLFNLNSCSKSKDLSAALALYDAALVSNDVSLSQQHFQTLLYLCSASISDPSLQSLAIDRGYQIFDRMVSSGISPNEASVTSVARLAAAKGDGDYAFKIVKDFVSAGGTSIPRLRTYAPALLCFCEKLEAEKGYEVEEHMDAAGIELEEAEISALLKVSCATSREDKVYRYLHKLRESVGYVCEETLKVIEEWFCGEKAGEFGDNGIGSDAGMLREAILKNGGGWHGHGWIGEGKWIVKKGNVSSTGRCLSCSEQLACVDTNEVETQKFVDSLVSLAMERKSKMNSCETKGDFSEFQDWLEKHGGYEAIVDGANIGLYQQNFADGGFSLPQIEAVVKELYHKSGNNKWPLILLHKKRVKTLLENLTHRNLVEEWINNGVLYATPPGSNDDWYWLYAAAKLKCLLVTNDEMRDHIFELLGNSFFQKWKERHQVRYTFSKGNLKLEMPSSFSVVIQESEKGSWHIPVSCQNIEESSRTWICIRRKSVLDSPKFNEKLATSGNGKILSSCNNNSLLSSCDAGNDQN

SEQ ID NO: 95 - protein, 522 aa, Eutrema halophila
MAASDQRRSRHHDESPSNPNKRKKTSQKPEKNLLINLHSCTKSKDLEAALALYDEAITSGDVRLGQQHFQSLLYLCSASISDPDLETLAIYRGFQIYDRMVSSGISPNESTVTAVARLAAAKGDGDFAFKLVLDIVAGGVSVPRLRTVAPALLCFCERLEARQAYEVEEYMDALGIVLEEVEISALLKVSIGTEQANKFYKYLHKLRENVGCVSEETSKIIEEWFREKASEVRGKVSDIELLRAAVLKNGGGWHGLGWVGEGKWIVKKGNVSPAGKCLSCGEHLACVDANEVETEKFVNSLVALAMERKAKMNSCEPTADFSEFQEWLEKHGDYEAILDGANIGLYQQNFADGGFSLPQLEAVVNELYKKSGNKKWPLILLHKKRVDALLGNPNHRELVEEWINNNVLYTTPPGSNDDWYWLYATAKLKCLLVTNDEMRDHIFELLSTSFFQKWKERHQVRYTYVKGCLKLEMPPPFSVVIQESEKGSWHVPITCQNIEESVRNWICIRRESLYIHSREKIQ

SEQ ID NO: 96 - protein, 572 aa, Eutrema parvulum
MLRATCFTPSLSWAIRPLFALILRIPSFHLPHRSFSPVHGYHTSLLVKGRRDRRLILVDHNRHLCTVPLAAKQSPALPSENVSRKARKKAIQQSPEAMLKQKLDMCSRNGDVLEALRLYDEAKRNSLQLSQYHYNVLLYVCSLSDAETESSSPNPGLSRGFDIFKQMIVEKVVPNEATFTNGARLAVAKDDPEMAFDMVKQMKAFGIQPKLRSYGPALFGFCKKGDADKAYEVDLHMLESEVVPEEPELTALLKVSMDTENAEKVYESLQRLRDLVRQVSKSTFDAIEEWFKSEAAAKAGVEKWDVKKIRNGVVSGGGGWHGQGWLGTGKWNVTRTEMDENGVCKCCKEKLVCIDINPVETENFAASLTRLACQKEVKASFNQFQEWLKRHGPFDAVIDGANMGLVNQRSFSFFQLNNVVQRFQQISPSKRLPLVILHKSRVIGGPATYPKNRALLEKWKNAGALYATPPGSNDDWYWLYAAVSCKCLLVTNDEMRDHLFQLLGTSFFPRWKEKHQVRISVSRENGLTLHMPPPYSIIIQESEDGTWHVPMSVEDDLQTSRQWLCARRSKTL

SEQ ID NO: 97 - protein, 554 aa, Eutrema parvulum
MAATGQRRSRQQDESPSKPNKKKKANKNPEKNLLFNLNSCSKSKNLSAALALYDAAVTSNEVQLSQQHFQTLVYLCSASISDPSLQTVAIDRGYQIFDHMVSSGISPNEASVTSVARLAAAKGDGDYAFKIVKDFASVGGISIPRLRTYAPALLCFCERLEADKGYEVEEHMDAAGITLEEAEISALLKVSAATGRENKVYRYLHKLREYVGCICEETSKIIEEWFCGEKAGEVSDKEIGADAGLLREAILKNGGGWHGHGWVGEGKWVVKKGNVSSAGRCLSCSQHLACVDTDEVETQKFVDSLVSLAMERKAKMNSCETKVDFSEFQDWLEKHGEYEAIIDGANIGLYQQNFADGGFSLPQLEAVVNELYHNSGDNKWPLILLHKKRVKTLLENPANKNLVEEWINKGVLYATPPGFNDDWYWLYAAAKLKCLLVTNDEMRDHIFELLGNSFFQKWKERHQVRYTFAKGNLKLEMPSPFSVVIQESEKGSWHVPVSCQNNEDSSRTWICISRQSTIHSPKVNGKVETSGNGKIISSCNNSLLSSCDAGINEN

SEQ ID NO: 98 - protein, 517 aa, Eutrema parvulum
MAASDQRRSRHDDESPSKPNKKKKASNNPEKNLLVNLHSCSKSKDLSAALALYDAAITSGDVRLTQQHFQTLLYLCSASLSDPSLQTLAIDRGFQIFELMVSSGISPNEASVTAVARLAAAKGDGDYAFKVVKDIVAVGGVSVPRLRTYAPALLCFCEILEAEKGYDVEEHMDASGIALEEVEISALLKVSVATGRENKVYRYLHKLREFVGCVSEETSEIIEEWFCREKASKVSGSGIGSDIVLLRAAVLKNGGGWHGLGWVGEGKWIVKKGNVTPAGKCLSCGEHLACVDTNEVETENFVNSLVALAMERKAKMNSSEPMADFSEFQEWLEKHGDYEAILDGANIGLYQQNFADGGFSLPQLEAVVKELYNKSGNKKWPLILLHKKRVNALLENPNHKNLVEGWINNNVLYTTPPGSNDDWYWLYAAAKFKCLLVTNDEMRDHIFELLSTSFFQKWKERHQVRYTFVKGSLKLEMPPPFSVVIQESEKGSWHVPITCQNCEESLRNWICITRQSL

SEQ ID NO: 99 - protein, 575 aa, Mimulus
MLFRVGSLSSKTSLLLSFFRKSSTAQFVQSKRFDSLLWRRYTSVTILINPQKQAYGTISMARKASHYSTTSAEALVQSSTNSGTRMSKKKARREAPEMILRVKLDLCSKDGNLTEALCLYNEARANGVQLNVHHYNVLLYLCCPNRDLSKEDEGNLTMLDRGFEIFKQMGIDKVEPNEATFTNLSRLAAAKEDPRLAFDLVKQMTEHGIVPKLRSYGPALFGFCKKGMADEAYEVDFHMRDNGVLPEETELTALLRVSSEFKKEGKVYEMIHRLRTTVRQVSEETAATITDWFKSKIASEIGEEKWDMEKVRKGFLEGGGGWHGQGWLGKGDWRVVRTTMDESGVCRSCGEKLVCIDIDPKETEKFAELLATLASQKEARTNFAKFQEWLQRQGPFDAVVDGANLGLANKHTFSFSQIARVVNELRQISPSKKLPLIILHQGRVSGGPAQNPNNKRLLESWKKGGSLYATPQGSNDDWYWLYAAVSCKCLLVTNDEMRDHLFNLLGNNFFPRWKEKHQARLKPSGDGLLTLHMPPPYSHVIQESKQGNWHIPTVTGDDLETPRQWICATRTRLHE

SEQ ID NO: 100 - protein, 573 aa, Mimulus
MCNLQNQLTKAYYMAFLSPKTPPILSVSPNSLFPSTKCIDYISCNAKNQVRKSPPIARTPRFSTSSGGQSLLQNERYSVTRRIKKQALRDSPEIMLRVNLDQCSKNGDLDEALRLYHEAKLNNIQLNVYHYNVLLYLCSLRSDDDGEEGLNPETLEKGFEIFKEMIIDRVELNEATFTNVSRLAAAKEDPELAFNLIKKMKDQGIGPKLRSYGPALFGFCKKGMADEAYEVDSHMVDNQVSAEESELSALLKVSSDVKREEKVYEMMHRLRATTRQVSEETAAVVEDWFLSERAAEVGLENWDTGKIKKGVLKGGGGWHGQGWLGGGDWRVVGTTMDEAGVCQSCGEKLVCIDIDPKETENFAKSLSELASKKEATTGFFQFQEWLQRHGPFDAVVDGANVGLANQHTFSFSQIKGVVNRLRELSPSKKLPLVVLHQNRVNGGPAQYPNNKKLLESWKKAGALYATPVGSNDDWYWLYAAVSSKCLLVTNDEMRDHLFNLLGNSFFPRWKEKHQVRLKPSSDGIRLHMPPPYSIVIQESEQGSWHIPTVTEDDLETPRQWLCATRARNSMPTP

SEQ ID NO: 101 - protein, 717 aa, Mimulus
MASFTFKPLLLQQTQLHLSSFSLSKNFNFYFSYDITPTKHQLKKLRVSAHSATSLSEDVAEANSGNDVNADFLSGLSSFAVADDVSNNSHVRNHNRAQKPIEKRVILKDRHAAKIGLNSKSRKQVVSSSSSSSSSSSSSIRFKATHSVNSNLIEHKNNNKVPDKQKEKRRSKKDKIDSPESTLRVGLDMCSKRGDVVGAIKLYELAKKEFIKLGQYHYAVLLYLCSSAATEVKRAALRKGFEIYNEMRLENIPMNEATFTSVARMATAFGDGDMAFDMVKQMKEYGINPRLRSYGPALSIFCSNGDIDNAFKVESHMLEHGVYPEEPELEALLKVSIDAGKSEKVYNVLHKLRTSVRQVSSSTAELIERWFTSKTASRVGKRKWDQNLIIEAMKNGGGGWHGKGWLGKGKWTVSRSPVDSDGLCKCCGKKLVTIDLDPVETENFAKSVASIAAEREKDSSFQKFQKWLDYYGPFEAVVDAANVGLYSQRSFKPSKVNAVVNGIRQMLHCRKWPLIVLHNRRINGGKMEEPFNKALIEKWRTADAIYATPTGSNDDWYWLYAAIKCGCLLVTNDEMRDHLFQLFGNDFFPKWKERHQVRFSFTETGPTFRMPPPCSVVIQETEEGQWHIPIVSESENEDERIWLCCSRSNSSSPSSSSHHQNQESEIPRTQKKKREARISVETVFGESGKRNHRKNNTLLAQLETAEQLGDCAIDFQI

SEQ ID NO: 102 - protein, 510 aa, Mimulus
MDHHNTRRKKQKLSPESQFRSTLDQCSKTKDLTAAISLYESSPSPTLTLGNLNSFLYICSNSLSDPETRQPAIEFGFKLFHHHSDGDNFKPNEATLTALSRLAAARGDGDYAFELAKSVKKYGVAPKLRTFSPALICFCGGAAAAADKAYEVEEYVESVGLHLEEPELAALLKVSIESGKEKKVYEYLHKLRATLREVDESTVAIIESWFSGKNAADVSVVSLDSDRIREANTRNGGGWHGLGFLGNGEWALQRSKIASYGQCCACNEQLVCVDTDTEETEKFAQSVASLAMERELHSNFKEFQDWLEKHSEYETVVDGANIGLYQQNFAEGGFSVTQLDAVVKETHSKSKKWPLVVMHKKRVRSILEDASKRELIEEWLDQGVLYGTPYGSNDDWYWLYAAVKLKCLLVTNDEMRDHIFELIGSNFFSRWKERHQVRYTFTKGGGLKLIMPPSYSLVIQESEKGSWHVPIAGEISDESSRTWLCVTRSGSIDAEEVSGNLIRNGSNNTS

SEQ ID NO: 103 - protein, 505 aa, Jatropha
MWRGSFLAPSFNRTSPLFSFFTKFPLLSIFRSVSNNFRCPLLHYHSCHFPKPLHYIQAYQFAMDRRARFCSFAHSTTPQIHESSVSGTNKVSRKSNKKARQESPEWVLKWKLDSCSKSGDLVEALRLYDEARSNGIQLTQHHYNVLLYLCSSGSSVELKGDRVVANASDLSFKRGFEIYQQMVTDKVAPNEATFTNVARLAFASEDPEMAFDLVKKMKGFDILPKLRSYGPALFGFCKKGMADRAYEVDTHMAESEVIAEEPELSALLKVSADAKRVEKVYEMLHRLRYTVRQVSDSTIGIIEDWFKSEDASKLGKQNWDVNKVREGIVRGGGGWHGQGWLGSGEWKTVRTKIDEQGICCSCGQKLVCIDIDPRETENFATSLANLACRKEVKADFVLFQYWLYAAVSCKCLLVTNDEMRDHLFQLLGTSFFPRWKEKHQVRVSVSRSGPALHMPPPCSIVIQESENGSWHIPTVTDDLETRRQWLCATRERHNYSDNNLAVSVA

SEQ ID NO: 104 - protein, 572 aa, Arabidopsis thaliana
MLRLTCFTPSFSRACCPLFAMMLKVPSVHLHHPRFSPFRFYHTSLLVKGTRDRRLILVERSRHLCTLPLAAAKQSAASPSENLSRKAKKKAIQQSPEALLKQKLDMCSKKGDVLEALRLYDEARRNGVQLSQYHYNVLLYVCSLAEAATESSPNPGLSRGFDIFKQMIVDKVVPNEATFTNGARLAVAKDDPEMAFDMVKQMKAFGIQPRLRSYGPALFGFCRKGDADKAYEVDAHMVESEVVPEEPELAALLKVSMDTKNADKVYKTLQRLRDLVRQVSKSTFDMIEEWFKSEVATKTGVKKWDVKKIRDAVVSGGGGWHGQGWLGTGKWNVKRTEMDENGVCKCCKEKLVCIDINPVETETFAASLTRLACEREVKANFNQFQEWLERHGPFDAVIDGANMGLVNQRSFSFFQLNNTVQRCQQISPSKRLPLVILHKSRVNGGPATYPKNRALLEKWKNAGALYATPPGSNDDWYWLYAAVSCKCLLVTNDEMRDHLFQLLGNSFFPRWKEKHQVRISVTREDGLKLNMPPPYSIVIQESEDGTWHVPMSVEDDLQTSRQWLCAKRSKTP

SEQ ID NO: 105 - protein, 528 aa, Arabidopsis thaliana
MAASDQHRSRRHDESSSRPNKKKKVSRNPETNLLFNLNSCSKSKDLSAALALYDAAITSSEVRLSQQHFQTLLYLCSASITDISLQYLAIDRGFEIFDRMVSSGISPNEASVTSVARLAAAKGNGDYAFKVVKEFVSVGGVSIPRLRTYAPALLCFCEKLEAEKGYEVEEHMEAAGIALEEAEISALLKVSAATGRENKVYRYLHKLREYVGCVSEETLKIIEEWFCGEKAGEVGDNGIGSDVGMLREAVLNNGGGWHGHGWVGEGKWTVKKGNVSSTGRCLSCSEQLACVDTNEVETQKFVDSLVALAMDRKTKMNSCETNVVFSEFQDWLEKHGDYEAIVDGANIGLYQQNFVDGSFSLSQLESVMKELYRESGNNKWPLILLHKRRVKTLLENPTHRNLVEEWISNGVLYATPPGSNDDWYWLYAAAKLKCLLVTNDEMRDHIFELLGSTFFQKWKERHQVRYTFVKGNLKLEMPSPFSVVIQESEKGSWHFPVSCENNEESSRTWMCISRQSILDSPKSNGKIP

SEQ ID NO: 106 - protein, 517 aa, Arabidopsis thaliana
MAGTDNRRSRHDDESPKNPNKKKKGNRNPEKSLLINLHSCSKRKDLSAALALYDAAITSSDIRLNQQHFQSLLYLCSAFISDPSLQTVAIDRGFQIFDRMVSSGISPNESSVTAVARLAAAKGDGDYAFKLVKDLVAVGGVSVPRLRTYAPALLCFCDTLEAEKGYEVEDHMDASGIVLEEAEISALLKVSAATGRENKVYRYLQKLRECVGCVSEETSKAIEEWFYGVKASEVSDNGIGSDIELLRAAVLKNGGGWHGLGWVGEGKWIVKKGNVSSAGKCLSCDEHLACVDTNEVETEDFVNSLVTLAMERKAKMNSCEPMADFSEFQEWLEKHGDYEAILDGANIGLYQQNFADGGFSLPQLEAVVKELYNKSGSKKQPLILLHKKRVNALLENPNHRNLVEEWINNNVLYATPPGSNDDWYWLYAAAKLKCLLVTNDEMRDHIFELLSNSFFQKWKERHQVRFTFVKGCLKLEMPPPFSVVIQESEKGSWHVPITSQDKEESLRSWMCITRQSS

SEQ ID NO: 107 - protein, 572 aa, Arabidopsis lyrata
MLRLTCFTPCFSRACCPLFAMMLKVPSVHIHHPRFSPFRSYHTSLLVKGTRDRRLILVERSRHLCTMPLAAAKQSAASPSENLSRKAKKKAIQQSPEALLKQKLDMCSKKGDVLEALRLYDEARRNGVQLSQYHYNVLLYVCSLAEAATESSPNPGLSRGFDIFKQMIVDKVVPNEATFTNGARLAVAKDDPEMAFDMVKQMKAFGIQPRLRSYGPALFGFCRKGDAGKAYEVDAHMVESEVVPEEPELAALLKVSMDTKNADKVYEMLQRLRDLVRQVSKSTFDTIEEWFKSEAAAKAGVKKWDVKKIRDAVESGGGGWHGQGWLGTGKWNVKRTEMDENGVCKCCKEKLVCIDINPVETETFAASLTRLACEREVKANFNQFQEWLERHGPFDAVIDGANMGLVNQRSFSFFQLNNTVQRCQQISPSKRLPLVILHKSRVNGGPATYPKNRALLEKWKNAGALYATPPGSNDDWYWLYAAVTYKCLLVTNDEMRDHLFQLLGNSFFPRWKEKHQVRISVSREDGLTLHMPPPYSIVIQESEDGTWHVPMSVEDDLQTSRQWLCAKRSKTP

SEQ ID NO: 108 - protein, 530 aa, Arabidopsis lyrata
MAASDQHRSRHHDESSSRPNKKKKISRSPETNLLFNLNSCSKSKDLSAALALYDAAVTSSELRLSQQHFQTLVYLCSASISDTSLRSLAIDRGFEIFDRMVSSGISPNEASVTSVARLAAAKGDGDYAFKVVKDFVSVGGVSIPRLRTYAPALLCFCERLDADMGYEVEEHMEAAGIALEEAEILALLKVSAATGRENKVYRYLHKLREYVGCVCEETSKIIEEWFCGEKAGEVSDNGIGSDVGMLREAVLKNGGGWHGHGWVGEGKWTVKKGNVSSTGRCLSCREQLACVDTNEVETQKFVDSLVALAMERKAKMNSCETQVDFSEFQDWLEKHGNYEAIVDGANIGLYQQNFVDGSFSLPQLESVVKELYRESGNNKWPLILLHKRRVRALLENPTHRNLVEEWISNGVLYPTPPGSNDDWYWLYAAAKLKCLLVTNDEMRDHIFELLGSSFFHKWKERHQVRYTFVKGNLKLEMPSPFSVVIQESEKGSWHFPVSCENNEESSRTWMCISRQSVLDSPKSNGKLATS

SEQ ID NO: 109 - protein, 517 aa, Arabidopsis lyrata
MAGTDHRRSRHHDESPSKPNKKQKGSRNPEKSLLINLHSCSKRKDLSAALALYDAAITSSDIRLNQQHFQSLLYLCSAFISDPSLQTLAIDRGFQIFDRMVSSGISPNESSVTAVARLAAAKGDGDYAFKLVKDIVVVGGVSVPRLRTYAPALLCFCESLEAEKGYEVEEHMDASGIMLEEAEISALLKVSAATGRENKVYRYLHKLRECIGCVSEETSKTIEEWFYGVKASEISDKTIGCDIELLRAAVSKNGGGWHGLGWVGEGKWIVKKGNVSPAGKCLSCGEHLACVDTNEVETENFVNSLVALAMERKAKMNSCEPMADFSEFQEWLEKHGDYEAILDGANIGLYQQNFADGGFSLPQLEAVVKELYNKSGNKKQPLVLLHKKRVNALLGNPNHRNLVEEWIDNNVLYATPPGSNDDWYWLYAAAKLKCLLVTNDEMRDHIFELLSNSFFEKWKERHQVRFTFVKGCLKLEMPPPFSVVIQESEKGSWHIPIKSQDNEESSRSWMCITRQSL

SEQ ID NO: 110 - protein, 567 aa, Brachypodium
MRLAAAAGALRPLFFHPHRQPRRLLSSLRRSSVPLARRRRHSYSSTSTALDDAPNNSPSPTLPGPGPPPAAGGGEGKASRRRRSRDSPEGLLKHKLDMCSRDGDLPTALALYDAALDPASSPPVPLSIHHYNCLLYLCSNAAATASDPDAASRGFEIFARMEAQGVEPNEATLTSVARLAAARRDPAMAFSVVRRMADAGIPPRLRTYGPALFAYCDAGDADGASEVEAHMDAGGVLPEETELAALLRVNADKGRADEVYRVLHRTRVLARQVCETTAQVIEAWFRSDAASQAGVDKWDAKKVKEGVVKGGGGWHGQGWLGKGQWDVERSEMDKNGKCQRCGEKLVCIDIDPSETENFAKSLTELACKREVRDDFLRFQGWLRRHGPFDAVIDAANIGLYNSKAFSFSQVNSVVNGIQRVTKSKKLPLIILHRSRVHCGPAIVPHNQKLIEGWRSAGALYSTPPGSNDDWYWLYAAVSCRSLLVTNDEMRDHLFQLLGTSFFPRWKEKHQVRLTYSGRGPTFHLPPPYSIVTQESEAGRWHVPTTTGDDIENPRQWICAIRKSQRRD

SEQ ID NO: 111 - protein, 729 aa, Brachypodium
MVSLFAPRPLPAHLRRFPAVSLPSVALSYLFSPLPCHARNLLDVLPLRDRNPGGVANGGTPRTEEGAAGSPVVSCTAAQGDVTREVEASVSSGHGRNRTRRWRRGDSRLVLGEGTDRDVKERGWRGGPARTGESEGRRRDRRWTRGGMRVQESGKDGNLGNLSPRGEDRGGNLKRGKRLKSSEQGVMLRVALDLCSKRGDVIGAINLYDSAVKEGIRMGQHHYNVLLYLCSSAALGIVQPAKSGSAGKLDPASVESSGHPEDSNVPEGHVQNQEGNETILFPSVQIGSSIPVSDEIREYARTRGFEIFEKMCSEKERVAMSKAALTGVARMATSMGNGDMAFEIVKQMKELGITPKLRSYGPALTAFCDSGNVEKAFEVEAHMLESGVTPEEPELEMLLRASVVARRGDRVYYLLHKFRNTVRQVSPSTAEQIEAWFRSSTASKVGKRKWDACALAKEIENHGGGWHGLGWLGRGKWTITRSHIDKNGVCLACGGKLAIIDLDPKETEDFATLVATLALKRERTSNFDNFQKWLDDHGPFEAVMDAANVGLFSHRHLSVSKVNAVADAIQKRFPSRKWPLIVVHNRHLTGKHMKNPANHKWVENWKRADIIYETPTGSNDDWYWLYAAIRWKCLIITNDEMRDHTFQLLEKDFFPKWKERHQVRFSFGDSCVTFQMPPPCSVVIQESEKGHWHIPLSEESLLEEERTWLCVMRRSSQALYNEAGVNSDL

SEQ ID NO: 112 - protein, 506 aa, Brachypodium
MATAAAGAAAAGARRRPRRGGSKGPNSDLSRTLTDCTRRGDAAAAMAAFDAAIVSGGPEDLRFAAHQYNQLLHLLASADRSSFPGGHPAVAASARRVFAHMLEATTAAPAEATITSLARVIASDPGGGDEAFELVATMRERYGLAPRLRSYGPVLAAFRRTGEAGKAYAVEAHMAASAVSPEEPELAALLDVSAKAGDADKVYEYMHKLRRAVACVSLETAEVLEGWFQSEKAAMAGKAEWDAQQVKDAIVANGGGCHQLGWLQNGPWVVRRATVGTDGECGGCGCCLASVDIDMEETQTFADSVSGLALERETKANFSHFQEWLEAHQEYEAIVDGANIALYQQNFADGGFSLVQLDAVVTELRDRYSGKWPLVILHNKRIAKLMENPSDRHLIETWRANGALYTSPSGSNDDWYWLYAAIGLNCLLVTNDEMRDHIFELLGSSFFHKWKQRHRVKYTFNKGKAVLLMPPPYSSEIQESETGSWHVPIEEKSGDERVRTWLCIGR

SEQ ID NO: 113 - protein, 552 aa, Physcomitrella patens
MQNAKRPAPNDQQDGDERKSKKKRDPAESELRRSIDMCSKHADAMGAIEIYDKVVAEGKMSFNQYSYNVLLYLCSSGATVVLTDEQKQLCLQRGFAVYEAMKLQGVPPNEATFTAVARLAVAKDDGDLAFDMVKQMAKAKLSPRLRSYSPALHTYCKLKNIEKAFEVDEHMLAAGVQPEESELEALLKLTADAGLEDKVYPLLHRIRTTVRGLSPSTAGVVQQWFESSAGANAGKSNWNSLPSQETVKAAYESRGGGWHGLGWLGRGSWEVKPSELDANGVCQECGEQLVTIDIDPKETVMFAKSLSELACQREGKSNEFKKFQGWLDRHGPFDVIVDGANVGLFNQNFGEGGFNFHQLNSVVKGIKEKVGSKREPLILLHHRRTRGGPASSSFAIKILNKWQETHAIYTTPTGSNDDWYWLFAAVKYKCILVTNDEMRDHLFQLLGNDFFPRWKERHQVRFSLSREGPVFHMPPPYSMLIQESVSGSWHIPKSGGEDVSAPVKWLCVTRTGQPNPEILKVEEKLNHLLAGAGETGPDSKPVEEANSELKQT

SEQ ID NO: 114 - protein, 520 aa, Physcomitrella patens
MAQNGKNHGTPDSSYAKGGKQPRAKNKQYAPEQDLRRALDMCSKHADVKQALEIYDKTCKEGKIAFNQYNYNIILYLCSSAATDSLKPQKKQRILYMKRGFEVYEAMKSQGVPPNEATFTAVARLAVAKEDGDLAFDMVKQMAEANLSPRLRSYAPALYTYCKLKNHKKAFEVDDHMKKSGVALEESELEALLKVSVGAGLEDKVYSLLHRLRTTVRDVSPSAVEVIQQWFTSSAAATAGKSNWEHLPGPEYVKKATESCGGGWHGLGWLGRGTWEVKSSVVDDHGVCQECGEPLATIDLDPQETEMFAQSLSRMACQREAKNNEFKKFQGWLDRHGPFDAIVDGANVGLYNSNTPNGGFNFYQLNSVVTGIQKRLGLKREPLILLHHRRTKGGPADSSFAARMLSNWKENNSIYTTPTGSNDDWYWLYAAVRFRCVLVTNDEMRDHLFSLLGNDFFPKWKERHQVVRYTINREGLVFHMPPPFSTVIQESHKGSWHVPKSGKNDEDVLVPREWLCVTRT

SEQ ID NO: 115 - protein, 526 aa, Physcomitrella patens
MPNAKRAAPYDQQNGDDRNHKKKKDSAESELRRSIDMCSKFADVMGAIEIYDKVVAEGKVAFNQYTYNVLLYLCSSAATEVVVTDEERRLCLERGFVIYEAMKLQEVPPNEATFTAVARLAVAKEDGDLAFDMVKQMANAKLSPRLRSYSPALHIYCKLKNFEKAFEVEEHMLAAGVQAEESELEALLQLATDFGLEYKVYSLLHRIRTTVRGLSPSCAGVVQQWFESSPAASAGKSNWDSLPSPKTVKAAYESRGGGWHGLGWLGRGNWEVKSSVLDTGGVCQECGQQLVTIDIDPNETEMFAKSLSELACQREGKNNEFKKFQAWLNRHGPFDAIVDGANVGLFNQNFVDGGFNFHQLNSVVKGIKEKIGSKRNPLILLHHRRTRGGPANSPHAIKMLKRWQEAHAIFTTPTGSNDDWYWLYAAVQYKCVLVTNDEMRDHLFHLLGNDFFPKWKERHQVRFSMSKEGPVYHMPPPYSILIQESVSGSWHIPKSGNDVSQPGEWLCVTRPGHAKADDMKEEKLKE

SEQ ID NO: 116 - protein, 536 aa, Selaginella moellendorffii
MATESSKPENLSNVKVETFPDVCSQWDQANSARPLYLEIEKRRVEEQERRASSPSPRKKKFNLVSEVRFTLDTCSKFGDVNGALSAYSSNREAVKFDLYNYNVLLYLCSSAALGEMMDGFLRKGLEIFEQMQAENVAPNEATFTALARLSVAKRDGDLAFEIVKAMIAAKIPPKLRCYGPALYVYFKRNDPEKAFEVYNHMLVHGVQPEEAELEVLLHLSSKACLGDRVYLLLHHLRETVRDVSQSTVSVIERWFKSDFAGRVTGNSLPGDFDVRCSSLAKGGGWHGLGWLGQGRWNVGYTSLTAEGVCCRCNEQMVTIDITPEDTDVFAKCIASLAFKRESNNSFGIFKDWLDRNGPFETVVDGANVGFYNQRFNGELNFAQLETVVADVQRRSGKWPLIVLHVGRTMKGSGRSSYAQQLLRHWSNAKALYIAPAGSNDDWYWLYAAVKCKSLLVSNDEMRDHIFQLLGREFFPTWKERHQVRFHVTKHGPVFHMPPPYSIIIQETERGSWHIPVSGGDDISSPRKWLCVTRGST

SEQ ID NO: 117 - protein, 532 aa, Selaginella moellendorffii
MPIASEVLEGDLPLRVNYLQLETKKRAATDNTNHESKRCVQKKKKFTPDSELRFKLESCSKVGDVTGALDIYDSSKDQGVKLSQYHYNVLLYLCSSAALGVILALDRGLEIYERMKLEGISANEAAFTSIARLAVAKRDGDLAFSLVKEMTTSGITPKLRSYGPALYTYFKSNRVDKAFEVDDHMRSFGVQPEEMELQILLELSLKAGQEQRVYSVLHRLRRSVREVSPSTATTIERWFSSDAASSSGSDKKYDDEDVRRALAAQGGGGLELGWIGSGRWSVKRTALDASGVCESCRHKMAAVDLNAEETNRFAENLAALACEKERDANSFKEFQEWMAEHGPFDAIVDGANVALFNQNFSAGGFSFSQLNSVVTELSNQHGKSPLVILHKRRVTGGPAASPQSQELLKQWTAANALYTAATGSNDDWYWLYAAVTCKCLLVSNDEMRDHLFQMLGNDLFPRWKERHQVKLRALSYNPFFDMPPPYSTVIQECENGSWHFPISRGNDEDDEAEEPHKQPRSWLCIRRDEETK

SEQ ID NO: 118 - protein, 213 aa, Brassica napus
MYNRFRVMLGTACFTPSLSRAYCPLFALFLRIPSVHHPHHPSSSPFRGYHSSLQVKGTRDRRRILVDQNRHLCTIPEAAKQPPASTSENLSRKARKKAIQQSPESMLKQKLDMCSRNGNVLEALRLYDEAKRNGLQLSQYHYNVLLYVCSLTDGETESPSANPGLSRGFDIFKQMIVDKVVPNEATFTNGARLAVAKDDPEMAFDMVKQMKAF

SEQ ID NO: 119 - protein, 241 aa, Brassica napus
MAANGQRRSRQDDESPSNPNKKRKANKNPEKNLLFNLNSCSKSKDLSAALALYDAAVASNEVRLNQQHFQTLLYLCSASISDPCLQTLAVERGYQIFDRMVTSGLTLNEATVTSVARLASAKGDGDYAFEIVKDFASLGGTSIPRLRTYAPALLCFCERLEAEKGYEVEEHMEAAGIALEEAEISALLKVSAATSRENKVYRYLHKLRESVGCVCEETSKVVEDWFCGEKAGEVSSDGIGS

SEQ ID NO: 120 - protein, 181 aa, Brassica napus
MATSDHPRSRHHRDESPTKPNKKKKASHNQEKNLLVSLHSCSKSKNLSAALSLYDAAIASGDVRLSQQHFQSLLYLCSASLGDPSLQTLAINHGFQVFERMVSSGISPNEASVTSMARLAAAKGDGDYAFKVVKDIVAVGGVSVPRLRTYAPALLCFCERLEAEKGYEVEEHMEASGIALE

SEQ ID NO: 121 - protein, 489 aa, Artificial Sequence
  mutant Oryza sativa_1
MLAPEGLLKAKLDMCSRDNDLPTALALYEAAISPDSLIPLSLGHYNCLLYLCANAAAADSSSPDAAQRGFDIFSRMEADGVQPNEATLTILARLAAARRDPAMAFSIVRRMATAGTAPHLRSYGPALFAYCDAGDADGATEVEAHMDASGVVPEEAELAALLRVNSARGRPDQVYRLLHRARVLLRQVADATAQLLESWFASHAASEAGLDHWDATKVKQGLRNGGGGWHGQGWLGKGQWTVARTDMDKDGTCHRCGEKLVCIDIDPSETHSFAESVAQIAINRDANFVKFQKWLECHGPFDAVIDAANVGLYNRNSFSFYEVNRVVNGIQRITKSKKLPLIILHKNRVNGGPAKLPQNQKLLESWQRAGALYATPPGSNDDWYWLYAAVIYRSLLVTNDEMRDHLFQLLGTSFFPRWKENHQVRLTFSGRGWNFHLPPPYSIVIQESEDGSWHVPTTNGDDIEKPRQWICATRKISGKSSQALARAVG

SEQ ID NO: 122 - protein, 548 aa, Artificial Sequence
  mutant Oryza sativa _2
MGGENEVKLRVELDMCSKRGDVIGAINLYDSAVKEGIKMGQHHYSVLLYLCSSAALGFVQPAKSGNAGSGIASIGQLHSSSTQSVGNLEGDDVQSEGHSEDQEGNKTDLFASDDGTEKPSRIPVSDELREYARTRGFEIFEKMRSEEEKVPMNESALTAVARMAMSMGNGDMAFDVVKQMKDQGIAPKLRSYGPALTAFCNSGNVEKAFEVEAHMLESGVRPEEPELETLLKASVAAQQGDKVYYLLHKFRTTVRQASSTTAKLLEDWFQSPTASKVGKRKWDSGAITKAIENNGGGWHGLGWLGRGKWTISHSHIDRNGACLACGEKLTIIDLDPKETEDFATLVAKLAIKRERRSNFDNFQKWLEKHGPFDAVVDGANVGLFSHKHISLSKINIVADVIRQRFQSRKLPLIVVHNRHLTGERMQKPSNRKLVEKWKLSNAIYATPTGSNDDWYWLYAAIRCKCLMVTNDEMRDHTFQLLERDFFPKWKERHQVRFNFEDSCVTLQMPPPCSVVIQESENGQWHIPVVSEEGSLEKDRTWLCVTRRN

SEQ ID NO: 123 - protein, 526 aa, Artificial Sequence
  mutant Oryza sativa _3
MGSKGPNSDLSRTLTDCTRRGDAAAAMAAFDSALSGPDAPRLLAHQYNQLFHLLATADADSLPNAAAAARRVFSHMLGSGASPSEATITSLARVTASDASNPAAADEAFDLVATMRDKYGVAPRLRSYSPVLAAFRRAGEAGKAYAVDAHMEASAVAPEEPEIAALLDVSAKAGDADKVYEYMHKLSRTVDCVGEETAEVLEGWFRSGKAAMAGKAEWDACKVKDAIVANGGGCHRLGWLGTGPWTVQRVRVGGDGQCEGCGCRLACVDIDVEETQRFADSVASLALQRETKINFSQFQEWLEEHGAYEAIVDGANIALYQQNFAEGGFSLTQLDAVVTELRDRYNGKWPLVVLHNKRIAKLMENASNRHLIETWRANGALYTSPIGSNDDWYWLYAAIRLNCLLVTNDEMRDHIFELLGSSFFPKWKQRHQVKYTFSKGKAVLMMPPPYSSEIQESEMGSWHVPMEEKSGDDRARIWLCIDRTGHCKHPHEAPAANGVVQDVSPTEASHGCEQRRAEHNGGSLTG

SEQ ID NO: 124 - protein, 483 aa, Artificial Sequence
  mutant Zea mays_1
MESPQGLLRHQLDMCSRNADLTTALRLYDDALSPDNPIPLSLHHYNCLLYLCSNAAATDSDSHISATAAQRGFDIFARMEADGVQPNEATLTSVARLAAATRDPAMAFSVVRRMAAAGTPPRLRTYGPALFAYCDAKDADGAKQVEAHMDASGVVPEEPELAALLRVNADTGKADEVYRLLHRTRVLVRQVCDTTAQVVEAWFRSDAASQAGVDSWDPTKVKEGVVKGGGGWHGQGWLGKGAWSVGWTEMGKDGTCQRCGERLVCIDIDPAETDNFANSLTELAIKLEAREDFLSFQSWLRRHGPFDAVIDAANVGLYKSKDFCFSQVNSVVNAIQRVTKSKKLPLIVLHRSRVNVGPAKAPYNQKILDSWRNAGALYATPPGSNDDWYWLYAAVSCRSLLVTNDEMRDHLFQLLGTSFFPRWKEKHQVRLTFSGHGPTLHLPPPYSIVIQESEDGSWHVPTTTGDDIEKPRQWLCTTRKSLR

SEQ ID NO: 125 - protein, 554 aa, Artificial Sequence
  mutant Zea mays _2
MDGEYAGKLRVELDMCSKRGDVMGAITLYDSAVEEGIKLGQHHYNVLLYLCSSASLGFVQPAKSGNMGSGIASIGPAQKLDPSPSRSLGGSEGDNAYASESHVQDQGKNKADLIPGGLKAQTVSIPVEDELGDYARARGFEIFDKMCSEKERVQMSEAALTAKARMALSMGDSDMAFEIVKQMKGLGLKPKLRSYGPALTAFCNSGNVEKAFEVEAHMLESGITPEEAELETLLRASVVGRRGDKVYYLLHKFRTAVRQVSHSTAELFEAWFRSPTASKVGKRKWDAGAIAKAIENNGGGWHGFGWLGRGKWTVAHSNINENGVCLACGEKLAIIDLDPKETEDFATFVAKLAIKRERKSNFENFQKWLEKHGPFEAVVDAANVGLFSHKHLSLSKVNSVADAIRLRFTSKKWPLIVLHNKHLIGERMKKLNDHKLVQKWKQENSIYATPTGSNDDWYWLYAAIRCKCLIITNDEMRDHTFQILERNFFPKWKERHQVHFTLEDRCVTFQMPPPYSVVIQESDKGHWHIPVSEEGLLEKDRTWLCVTRQNSQAQ

SEQ ID NO: 126 - protein, 503 aa, Artificial Sequence
  mutant Zea mays _3
MGSKGPNADLSRTLTDCTRLSAHQYNQLLHLLAATDRSSFPSPPAAAARRVFAHMLQAAAPPSEATITSLARVIAADPASAADEAFELVATMKDKYGLSPRLRSYGPVLAAFRRAGEAAKAYAVEAHMTASGVSPEEPELAALLDVSSRAGDADKVYEYMHKLRQAVHCVSEETAGVVEAWFRSDEAATAGKPQWDAAQVKDAIVANGGGCHRLGWLGTGPWTVQRVRVGDADQCGGCRFHLACIDIDMEETQRFADSVAGLALERETKTNFSRFQEWLEANKDYQAIVDGANIALYQQNFAEGGFSLTQLDGVITELRDRYHGKWPLVILHNKRISKLMENSSNRHLIETWRTNGALYTSPSGSNDDWYWLYAAIKLNCLLVTNDEMRDHIFELLGPSFFPKWKQRHRVKYTFNKGKAVLVMPPPYSSELQESEMGSWHIPIEEKSGNERGRIWLCIGRGGSCKEHGEVPSTNGAVHKVPQTEASNVVQQGLTENKDESITG

SEQ ID NO: 127 - protein, 663 aa, Artificial Sequence
  mutant Triticum turgidum 1
MESPAGILRHRLGICSRDADLATALELYADAVDPATAVPLALHHYNCLLYLCSNAAAEDADAARRGFEIFAAMEAQGVEPNEATLTSLARLAAAVRDPAMAFSVVRRMAAAGIPPRLRSYGPALFAYCDARDAHGAAEVEAHMDAGGVVPEETELAALLRVNADTGRADQVYRVLHRTRTLVRQVCEATAQVVEAWFQSDAAAEAGVEKWDARKVREGVVKGGGGWHGQGWLGKGQWDVGQSEMDKNGKCQRCGEKLVCIDIDPSETETFAKSLAELACKREVRDDFVRFQDWLRRNGPFDAVIDAANVGLYNSKAFSFSQVNSVVNGIQRVTKSKKLPLIVLHRSRVNCGPAKAPQNQKLIESWRNAGALYSTPPGSNDDWYWLYAAVSCRSLLVTNDEMRDHLFQLLGTSFFPRWKEKHQVRLTYSGRGPTFHLPPPYSIVIQESETGSWHVPTTTGDDIESPRQWVCATRKTSEGPPSPPPQARVSSKTSERLPSPPPQACATRKTSERPPSPPPQARATRKTSEGPPSPPPQARATSKTSERLPSPQPQARATSKTSERPPSLQPQARATSKTSERPPSPPPQARSTRKTSERPPSPPPQAHGTRKTSERPSSPPSQASATSKTTEGPSSPPSQASATIKTSEGPSSPPPQARLSDLGW

SEQ ID NO: 128 - protein, 531 aa, Artificial Sequence
  mutant Triticum turgidum 3
MGLGGKGPNSDLSRTLTDCTRRGDAAAAMAAFDAALSGPDAAPGLRLAAHQYNQLLHLLASADRAAFPARPAAAARRVFAHMLGAGAPPSEATITSLARVVAADDAEGADEAFGLVSTMREKYGLAPRLRSYSPVLAAFRRAGEAGKAYEVEAHMAASAVSPEEPEIAALLEVSAKAGDADKVYEYMHKLRRAVGCVKEETAEVLEGWFESEKAAAAGKAEWDVCQVKDAIVANGGGCHQLGWLRTGPWTVQRVRVGADGECSGCGCRLASVDINMEDTQKFADSISGLALERETKANFSQFQEWLEAHKEYEAIVDGANIALYQQNFAEGGFSLVQLDAVVTELRDRYSGKWPLVILHNKRIAKLMENSSNRHLIETWRANGALYTSPSGSNDDWYWLYAAIGLNCFLVTNDEMRDHIFELLGSSSFFYKWKQRHRVKYTFNKGKAVLVLPPPYSSEIQESETGSWHVPIEEKSGDERARTWLCIGRTDLSKPPREPPVANGVAQDLSPSEASNGAGQRQPEEQAAPVTG

SEQ ID NO: 129 - protein, 481 aa, Artificial Sequence
  mutant Solanum lycopersicum_1
MDAPESVLRHQLDQCSKRGDLQEAIRLYEEAKLNNITLNVHHYNVLLYLCSSGSGTEGCGIEKGFLIFKQMGVNGVAPNEATFTSAARLAVAKQDPEMAFDLVKKMKSFGVPPKLRSYGPALFGFCEKGMADKAYEVDVHMGESGVVAEEAELSALLKVSSFSKKADKVYEMMHRLRASVRQVCEETVGVVEDWFNSEYAAEVGLQDWDARKVKEGVVKGGGGWHGQGWLGKGNWTVVRAEMDSSGVCRSCGEKLVCIDIDPKETENFANSLAELASEREVKANFVQFQDWLQKHGPFDAVVDGANVGLITQRNFNFSQLRSVVNKLRQMSESKKLPLVILHKSRTTGGPAQHPNNKKLLESWKKAGALYATPHGSNDDWYWLYAAVSSKGLLLTNDEMRDHLFQLLGTSFFPRWKEKHQIRMTASRDDGLKLHMPPPYSIVIQESEQGCWHIPTLTGDDLEIPRQWVCATRKKALHSVFR

SEQ ID NO: 130 - protein, 645 aa, Artificial Sequence
  mutant Solanum lycopersicum _2
MIDSTLRIGLDMCSKRGDVLSAIKLYDLALLQGIVMGQYHYAVLLYLCASAATGLIHPAKSGSVNRTLNAPNEQEFSLNDKVIEHDSHLLSSSTVDEFVQFMKSSAKSVRHDDNGIKVSEDVRHYALTRGFEIYEKMLSDKVQINEATLTSVARMAMALGNGDMAFDVVKKMKEDGINPKLRSYAPALSVFCNNGDVDKAFIVEQHMLENGIYPEELELEALLKVSIEAERSEKVYYLLHKLREGVRQVSPSTADLIDKWFNSKVASRVGKRKWDVRSIHKAIKNGGGGWHGQGWLGNGKWTVSHGIVGSDGCCKCCAEKLVTIDLDPEETEKFAKSVASIAAQRERNSSFQKFQRWLDYYGPFEAVIDGANVGLYSQRKFRPSKVNAVVNGIRQMLPSKKWPLIVLHNRRITGDKMDEPFNRSLVEKWKNADAIYATPTGSNDDWYWLYAAIKFRCLLVTNDEMRDHLFQLLGNDFFPKWKERHQVRFSFSETGPVFHMPPPCSIVIQESEEGNWHVPIASELESEEERTWLCIRRANSPMAHQDSSRVNISKNVGGPTHKCPPTSSDSPHNKGDAKSSTRRKNQVKVTGKTRGSHCRGKDAPEEMYRSLKNILQPSITSDHCSILPELKAAEELGRCVVDFQI

SEQ ID NO: 131 - protein, 544 aa, Artificial Sequence
  mutant Solanum lycopersicum _3
MNLTPEGQFRSSLDNCSKTKDLSTAISLYESAISDASTIRLSSNHFNSFLYICSNSFSDPSTKNDAIQFGFRVFEHMDSCNITPNEATVTAVARLAAATDDGDRAFELAKGVGNCGKLRTYGPALFCFCKMGEADKAYQVEEHMRSLGLQLEEAELAGLLKVSVEKEREEKVYQYLHKLRMSIRSVSDSTAEIIQSWFGGEMATKVGLSNGDMDQVKEVILQNGGGWHGLGWLGKGKWLAQRSQIAPDGRCLSCGEQLVCVDIDRSETERFAESVASLAMEREVHSNFKEFQDWLEKHSDYDAVVDAANVGLFQQNFAAGGFSIAQFVAVVKELHSRSNKWPLVILHKKRVRTLLEDAGYRELLEEWINEKILYGTPFGSNDDWYWLYAAVKCKCLLVTNDEMRDHIFELLGSSFFARWKERHQVKYTFVKGEIKLLMPPTYSVVIQESENGSWHVPLAGEVVEESSRTWLCITRQASCESDNKQLASVVEASEVSEPDQIAACCHSDSFTSQNGGSLNKCSGLAGKRKERSPSPTPSHSSLQS

SEQ ID NO: 132 - protein, 484 aa, Artificial Sequence
  mutant Brassica rapa 1
MAIQQSPESMLKQKLDMCSRNGNVLEALRLYDEAKRNGLQLSQYHYNVLLYVCSLTDGEAESPSANPGLSRGFDIFKQMIVDKVVPNEATFTNGARLAVAKDDPEMAFDMVKQMKAFGIQPRLRSYGPALFGFCRKGDAEKAYEVDAHMIESEVVPEEPELTALLKVSMETKNAEKVYETLQRLRDLVRQVSKPTFDAIEEWFESEAAGKAGVEKWDVKRIREGVVSGGGGWHGQGWLGTGKWNVTRTEMDENGVCKCCKEKLVCIDINPVETENFAASLTRLACQKEVKASFNQFQEWLERHGPFDAVIDGANMGLVNQRSFSFFQLNNVVQRFQQISPSKRLPLVILHKSRVVGGPATYPKNRALLEKWKNAGALYATPPGSNDDWYWLYAAVSCKCLLVTNDEMRDHLFQLLGTSFFPRWKEKHQVRISVSREDGLKLHMPPPYSIIIQESEDGRWHVPMSVEDDLQTSRQWLCARRSKTH

SEQ ID NO: 133 - protein, 512 aa, Artificial Sequence
  mutant Brassica rapa 3a
MANKNPEKNLLFNLNSCSKSKDLSAALALYDAAVASNEVRLNQQHFQTLLYLCSASISDPCLQTLAVERGYQIFDRMVTSGLTFNEATVTSVARLASAKGDGDYAFEIVKDFASVGGTSIPRLRTYAPALLCFCERLEAEKGYEVEEHMEAAGIALEEAEISALLKASAATSRENKVYRYLHKLRESVGCVCEETSKVIEDWFCGEKAGEVSSDGIGSDVEMLREAVLRNGGGWHGRGWVGEGKWIVKKDNVSSTGRCLSCNEQLACVDTNEVETQKFVDSLVALAMERKAKMISSETKVDFSEFQDWLEKHGDYEAIVDGANIGLYQQNFADGGFSLSQLEGVVNELYHKSGDKKWPLILLHKKRVRTLLENPTHRNLVDEWINNGVLYATPPGFNDDWYWLYAAAKLKCLLVTNDEMRDHIFELLSNSFFQKWKERHQVRYTFTKGNLKLEMPPPFSVVIQESEKGSWHVPVASQNNESSRTWMCISRRSVLDSLMINGKLETSENGDSS

SEQ ID NO: 134 - protein, 491 aa, Artificial Sequence
  mutant Brassica rapa 3b
MASHNQEKNLLVSLHSCSKSKNLSAALSLYDAAIASGDVRLSQQHFQSLLYLCSASLGDPSLQTLAIDRGFQVFERMVGSGISPNEASVTSMARLAAAKGDGDYAFKVVKDIVAVGGVSVPRLRTYAPALLCYCERLEAEKGYEVEEHMEASGIVLEEVEISALLKVSAATGRENKVYRYLHKLREYVGFVSEETSKVIEEWFCSEKASEVVRIGSDVELLRAAALKNGGGWHGLGWVGEGKWVVKKGNVSADGECLSCGEHLACVDTNEVETENFVNSLVALAVERKAKMNSSEPMEDFSEFQEWLEKHGDYEAILDGANIGLYQQNFADGGFSLPQLEAVVKELYSKSGNKKWPLILLHKKRVNALLENPNHRNVVEEWISNDVLYTTPPGSNDDWYWLYAAAKFKCLLVTNDEMRDHIFELLSTSFFQKWKLRHQVRYTFVKGSLKLEMPPPFSVVIQESEKGSWHVPITCKDGEESLRNWMCVTRQS

SEQ ID NO: 135 - protein, 483 aa, Artificial Sequence
  mutant Carica papaya 1
MARRESPEGVLRYKLDMCSKHGDLVEALHLYDEARREGVQLSQYHYNVILYLCSSGGSSVEVSGDWDGEKDSVLGLKRGFDIFGQMVADKVAPNEATFTSIARLAVAMDDPDKAFDLVKQMTSFGIPPKLRSYGPALFGFCKKGKVDNAYEVDAHMVEAGVMAEEPELSALLKVSADGKKADKVYEMLQRLRATVRQVSESTAEIVEDWFKSDDAATVGVDNWDENLVKEGIVKGGGGWHGQGWLGTGKWNVVRTQMNEKGVCRSCGEKLGCIDINPTETENFATSLTNLACQREVRADFTCFQEWLETHGPFDAVIDGANVGLINQHTLSFNQLNNVVNQLREMSPSKRLPLVILHKSRATGGPAQKPKNKYLLESWKKSGALYATPPGSNDDWYWLYASVSCKCLLVTNDEMRDHLFQLLGTSFFPRWKEKHQIRLSVSRNGLKLHMPPPYSIVIQESENGSWHVPTTTRQWLCATRTRLR

SEQ ID NO: 136 - protein, 700 aa, Artificial Sequence
  mutant Carica papaya 2
MADSPGFKLRVELDMCSKRGDVTSAIQLYDKALKEEIKLEQYHYSVILYLCSSAAAGVVQPAKSGSISRTLNTLSLSNESYRVNAIELGESMDRSNGNASHTELNINFSNNEQLVGTDGGHFEDIDKMASSGVRFENLGNNCKEEENLIQFPNGSMKPNSQLWGKMGIGDHSNQKHMSGITQDHEILVTEDIKKYALHRGFEIYKKMRLDGVPMNEAILTAVARMAVSTGNGDMAFDMVKLMESLGITPRLRSYSPALSAFCTSGDIDKAFAVEKHMLAHGIHPEEHEIEALLKLSVEAGKGDKVYYLLHKLRTTVRKVLPSTADIIVKWFESEVASRVGKKKWDARLIKEAIENGGGGWHGQGWLGEGKWVVSRTVIGRDAFCKCCGEKLAMIDLDPLETENFAQSVASIARKREKNRSFQKFQKWLDYYGPYEAVIDAANVGLFSQKKFKPSKVNAIVNGMRQMLPSRKWPLIVLHNKRITGPKMNEPANKTLFDKWKNADALYATPTGSNDDWYWLYAAIKFKCLIVTNDEMRDHTFQLLGNDFFPRWKERHQVHFSFSDAGPVFHMPPPYSVVIQESEKGHWHIPIAAEHDYEAERIWLCIARSQSGKMRQTLPAAHQVDLQSLERHLGPSTPTDFNIKSNRSSASMAENGSKETREMYQNLKNILTGPMISNNCSVLSELEAAEKIGDCVIDFQI

SEQ ID NO: 137 - protein, 491 aa, Artificial Sequence
  mutant Carica papaya 3
MNRNPEIDLLVNLQSCSKSKDLTTAISLYDSGISQNIRINQHHFSILLYICAASVTDPSSKSLAIERGFRIFDHMVSSGMSSNEASITSVARLAAAKGDGDYAFALIKDLVANGGLPRLRTYSPALLYFCENLEDGKAYEVEEHMDRMNVSLEEAEMAALLKVSAEVGKEERVYRYLHKLRGSVRCVSKETAKIIENWFSGEKGSAVGNGVEYSATEIREAVSKTGGGWHGLGWLAGRGKWVVRRANVEETGRCCCCGEQLACVDIDEIETEKFANSVAALAMEREAKLNFSDFQDWVEKHAPYEAIVDGANIGLYRQNFADGGFSIPQLDAVVKEMYCRSGNKWPLVILHDKRLRGLLENPSCRKVVEEWMDNGVVYKTPHGSNDDWYWLYAAVKLRCLLVTNDEMRDHIFELLGSSFFLKWKERHQVRYTFPKGSLKLQMPSPYSLAIQESENGSWHVPIASDSSLEYGKSWLCITRPSACASEVQVKS

SEQ ID NO: 138 - protein, 488 aa, Artificial Sequence
  mutant Solanum tuberosum 1
MDAPESVLRHQLDQCSKRGDLQEAIRLYEEAKLNNITLNVHHYNVLLYLCSSGSGTEGCGIEKGFQIFKQMGVNGVAPNEATFTSAARLAVAKQDPEMAFDLVKKMKSFGVPPKLRSYGPALFGFCEKGMADKAYEVDVHMGESGVVAEEAELSALLKVSSFSKKADKVYEMMHRLRGSVRQVCEETAGVVEDWFNSEFAAEVGLQDWDVRKVKEGVVKGGGGWHGQGWLGKGNWTVVRAEMDSSGACRSCGEKLVCIDIDPKETENFANSLVKLACEREVKANFVQFQDWLQKHGPFDAVVDGANVGLITQRNFNFSQLRSVVNKLRQMSESKKLPLVILHKSRTTGGPAQHPNNKKLLESWKKAGALYATPHGSNDDWYWLYAAVSSKGLLLTNDEMRDHLFQLLGTSFFPRWKEKHQIRMTASRDDGLKLHMPPPYSIVIQESEQGCWHVPTLTGDDLEIPRQWVCATRKKALHSLFRRNGESNH

SEQ ID NO: 139 - protein, 624 aa, Artificial Sequence
  mutant Solanum tuberosum 2
MIDSTLRIGLDMCSKRGDVLSAIRLYDLALLQGIVMGQYHYAVLLYLCASAATGLIHPAKSGSGSRTLNAPNEPSSHNNSNEFNVIDHDSHLLGSSTVDEFVQFMKSSAKRCNLQSVRHDDSGIKVSEDVRHYALTRGFEIYEKMLSDKVQMNEATLTSVARMAMALGNGDMAFHVVKKMKEDGINPKLRSYGPSLSVFCNNGDVDKAFIVEQHMLENGIYPEEPELEALLKVSIEAGRSEKVYYLLHKLREGIRQVSPSTADLIAKWFNSKVASRVGKRKWDVRSIHKAIKNGGGGWHGQGWLGNGKWTVSRAIVGSDGCCKFCAEKLVTIDLDPEETEKFAKSVASIAAKRERNSSFQKFQRWLDYYGPFEAVIDGANVGLYSQRKFRPSKVNAVVNGIRQMLPSKKWPLIVLHNRRITGDKMDEPFNRSLVEKWKNADAIYATPTGSNDDWYWLYAAIKFRCLLVTNDEMRDHLFQLLGNDFFPKWKERHQVRFSFSETGPVFHMPPPCSIVIQESEEGYWHVPIASELESEEERTWLCIRRANSPMANQDSSTVNISKNVGDPTHKCPPTSSDPPHNQGDARSSTRRKNQVKVTGKTHGSHGRELKAAEELGSCVVDFQI

SEQ ID NO: 140 - protein, 543 aa, Artificial Sequence
  mutant Solanum tuberosum 3
MNLTPEGQFRLSLDNCSKTKDLSTAISLYESAISEPSTIRLSNNHFNSFLYICSNSFSDPSTKNDAIQFGFRVFEHMGSCNITPNEATVTAVARLAAATDDGDRAFELAKGVGSCGKLRTYGPALFCFCKMGEADKTYQVEEHMRSLGLQLEEAELAGLLKVSVEKEREEKVYQYLHKLRMSIRSVSDSTAEIIQSWFGGEMASKVGLSNWDMDQVKQAILQNGGGWHGLGWLGKGKWLAQRSQIAPDGRCLTCGEQLVCVDIDRAETERFAESVASLAMEREVHSNFKEFQDWLENSDYDAVVDAANVGLFQQNFAEGGFSIAQLVAVVKELHSRSNKWPLVILHKKRVRTLLENAGYRELLEEWINEKILYGTPFGSNDDWYWLYAAVKRKCLLVTNDEMRDHIFELLGSSFFARWKERHQVKYTFVKGEIKLLMPPTYSVVIQESKIGSWHVPLAGEVVEESSRTWLCITRQASCESDNKQHASVVEASQVSELNQIAASCHSGSFTSQNGGSLNKCSGLAGKRKERSPSPTPSHSSLQS

SEQ ID NO: 141 - protein, 452 aa, Artificial Sequence
  mutant Nicotiana tabacum 1
MDAPESVLRHKLDQCSKHGDLQEALRLYEEAKLNNISLNVHHYNVLLYLCSASCTKEFGIEKGFEIFKQMGVNGVTPNEATFTSAARLALAKQDPKMAFDIVKKMKSCGVPPKLRSYGPALFGFCDKGMADNAYEVDIHMGESGVVAEEAELSALEDWFNSECAAEIGVENWDVGKVKEGVVKGGGGSHGQGWLGKGNWSVVRAEMDSSGVCSSCGEKLVCIDIDPKETENFANSLAKLACEREVKANFVQFQEWLQKHGPFDAVVDGANVGLITQRSFNFSQLRNVVNKLRQMSKSNKLPLVILHKSRATGGPAQHPNNKKLLESWKKAGALYATPHGSNDDWYWLYAAVSSKGLLLTNDEMRDHLFQLLGTSFFPRWKEKHQIRMTASRDDGLELHMPPPYSIVIQESEHGCWHVPTVIGDDIEMPRQWVCATRRKALHSLFQPTGESNH

SEQ ID NO: 142 - protein, 421 aa, Artificial Sequence
  mutant Nicotiana tabacum 2
  misc_feature (88)..(88): Xaa can be any naturally occurring amino acid
MIDSTFKIGLDMCSKRGDVVGAIRLYELALQEGIAMGPYHYAVLLYLCASAATGVVQPAKSGSGSNRTLNSLDLPKGSTSVKIKASSXGKVTNLTNMLSFSSDTNCQTLDELVQLFESRAEASNTISDHGIKVSEDVKHYALKYGFEIYEKMRSEKVQMNEATLTSVARMAMALGNGNMAFDVVRLIKEYGINPRLRSYGPALSVFCNNGDVDKAFMVEEHMLEHGVYPEEPELEALLKVSVEAGRSEKVYYLLHKLREGVRQVSPSTADLIEKWFNQAGVQGVGKRKWDERTYAKLFKTGGGGWHGQGLVGDDWYWLYAAIKFKCLIVTNDEMRDHLFQLLGNDFFPKWKERHQVHFSFSETGPVLHMPPPCSVVIQESEKGYWHVPIVSQQGSEEERTWLCIRRANSPLAKQESSSVDI

SEQ ID NO: 143 - protein, 527 aa, Artificial Sequence
  mutant Nicotiana tabacum 3
MNLTPEVQFRLSLDNCSKTKDLSTAISLYESALSTIRFSNNHFNSFLYICSNAVSDPSTKNPAIEFGFRIFDHMVSSNVTPNEATVTAVARLAAATDDGDKAFELAKGVGNCGKLRTYGPALFCYCKMGEADKAYQVEDHMRSIGLQLEEAELVGLLKASVVKEREEKVYQYLHKLRMSVRSVSASAAEIIQSWFGGEMAAKLGLSDWDMGQVKEAILQNGGGWHGRGWLGKGKWIVQRSQIAPDGRCLTCREQLVCVDIDKAETERFAEAVASLAMEREVHSNFKEFQDWLEQHSEYDAVVDAANVGLYQQNFAEGGFSIAQLVTVVTRIAHKWHWCIHKSVFVHSENAYIESCLRVINEKVLYGTPFGSNDDWYWLYAAVKRKCLLVTNDEMRDHIFELLGSSFFAIWKERHQVKYTFVKGEPKLLMPPTYSVVIQESENGSWHVPLAGEVAEESSRSWLCMSRHDKQHTSVEAAEVSELVCSDQIEDSCHSDSFASQNGLNTCSGLAGKRKERSPSPSHSSLQS

SEQ ID NO: 144 - protein, 518 aa, Artificial Sequence
  mutant Setaria_1
MHSYSSTATVADPTPTLEDSGGARGEAEGKAARRRRARESPEGLLRHQLDMCSRNADLTTALRLYDAALSPDSPVPLSLHHYNCLLYLCSNAAASDPESSAAAAQRGFDIFARMEADGVQPNEATLTSVARLAAATRDPAMAFSVVRRMAAAGTPPRLRTYGPALFAYCDAKDADGAGQVEAHMDASGVVPEEPELAALLRVNADKGRADEVYRLLHRTRALVRQVCDTTAQVVEAWFRSDAASEAGVDKWDPSQVREGVVKGGGGWHGQGWLGKGQWSVGRSEMDKEGTCQRCGERLVCIDIDPSETDNFANSLTELAIKREVREDFLGFQRWLRRHGPFDAVIDAANVGLYNSKAFSFSQVNSVANAIQRVTKSKKLPLIILHRSRVNGGPAKAPFNQKILEGWRNAGALYATPPGSNDDWYWLYAAVSCRSLLVTNDEMRDHLFQLLGTGFFPRWKEKHQVRLTFSGRGPTLHLPPPYSIVIQESEDGTWHVPTTTGDDIEKPRQWICSTRKSFK

SEQ ID NO: 145 - protein, 692 aa, Artificial Sequence
  mutant Setaria_2
MAREVLDVMPRRDGGRPPRTEEGRTGSAGVRHGANGGTVRGDTTSREAGTPLQREGSRGVPRPWKKGDRVVGEERLDWESQEKNWRRGPIRTGEQEWQRDGKRWTRGGNGMWEKESGNSGNSRDVDRGSRNVTKKKMRVKGGEQGGKLRVLLDMCSKRGDVMRAISLFDSAIEDGIRLGQHHYNVLLYLCSSAALGFVQPAKSGNTASGITSIGPAQKLDSSPSGSLGGSEVDDASEGLVQDQEKEKAEMLPSGDLTVQTITIPVGDELREYARARGFEIFEKMCAEKERVQMSEAALTAKARMALSMGDGDMAFEVVKQMKDLGITPKLRSYGPALTAFCNSGNVEKAFEVEAHMLECGITPEEAELKMLLRVSVVGRRGDKVYYLLHKFRAAVRQVSLSTAQLFEAWFRSPTASKVGKRKWDAGVISKAIENNGGGWHGFGWLGRGKWTVTRSHINKNGACLACGEKLTIIDLDPKETEDFATFVSKLAIKRERNSNFEKFQKWLEKHGPFEAVVDAANVGLFSHKHLSLNKVNAVADAIRQRFASRKWPLIVLHNRHLTGERMKKPGNHKLVEKWKQANSIYATPNGSNDDWYWLYAAIRCKCLIITNDEMRDHTFQILEKDFFPKWKERHQVHFTYDESSVTFRMPPPYSVVIQESEKGHLHIPISEEGLLEKDRTWLCVTRRNSQER

SEQ ID NO: 146 - protein, 493 aa, Artificial Sequence
  mutant Setaria_3
MAAHQYNQLLHLLATADRSSFPSAAAAARRVFAHMLQAGAPPSEATITSLARVTAAPDADNPASAADEAFELVATMREKHGLAPRLRSYSPVLAAFRRAGDASKAYAVEAHMAASGVSPEEPELAALLDISSTAGDADKVYEYMHKLRQTVDCVTEETAQVVEGWFSSDNAGVAGKAEWDAAQVKDAIVLNGGGCHRLGWLGTGPWTVQRVRAGADCQCAGCKCQLACVDIDMEETQRFADAVAALALERETKANFSQFQEWLEENKEYEAIVDGANIALYQQNFAEGGFSLTQLDAVITELRGRYHGKWPLVILHNKRIAKLMENSSNRHLIETWRANGALYTTPSGSNDDWYWLYAAIKLNCLLVTNDEMRDHIFELLGSSFFPKWKHRHRVKYTFNKGKAVLVMPPPYSSEIQESEVGSWHVPLEEKSGDERVRIWLCIGRTGTCKEPDEVPTTNGVVQEVPPNEESNGVQQSLQEDKAESITGKRKDRD

SEQ ID NO: 147 - protein, 505 aa, Artificial Sequence
  mutant Sorghum bicolor_1
MPALEDSSPSNGEGKAARRRRARESPEGLLRHQLDMCSRNADLTTALRLYDDALSPDTPVPLSLHHYNCLLYLCSNAAATDTDTDSSTAAAQRGFDIFARMEADGVQPNEATLTSVARLAAATRDPAMAFSVVRRMAAAGTPPRLRSYGPALFAYCDAKDADGAKQVEAHMDASGVVPEEPELAALLRVNADKGKADEVYRLLHRTRALVRQVCDTTAQVVEAWFRSDAASQAGVDKWDPSKVKEGVVKGGGGWHGQGWLGKGAWSVGWTEMDKDGTCQRCGEKLVCIDIDPSETDNFANSLTELAIKREVKEDFLGFQNWLRRHGPFDAVIDAANVGLYNSKAFSFSQVNSVVNAIQRVTKSKKLPLIILHRNRVNGGPAKAPYNQKILESWRNAGALYATPPGSNDDWYWLYAAVSCRSLLVTNDEMRDHLFQLLGTSFFPRWKEKHQVRLTFSGRGPTLHLPPPYSIVIQESEDGSWHVPTTTGDDIEKPRQWMCTTRKSSK

SEQ ID NO: 148 - protein, 643 aa, Artificial Sequence
  mutant Sorghum bicolor _2
MAYLSTTRFIPVYHRCIFFSASSSPPIVTRRCPVPTLSCHGRDVLDVMPNRDSRIPGTEESRAGPAGPPRGTNGPTVREDATAQEARTPLWREGSRGAPRTWRKGDRVVLQERVEWVSQERSWRRGLTRSLGSEGPRAGKRWTREGNGMRAKESGKVGNSRDEGTGGGEYAGKLRVELDMCSKRGDVMGAIALYDSAVEEGVRLGQHHYNVLLYLCSSASLGDDLREYACARGFEIFEKMCSEKERVQMSEAALTAKARMALSMGDSDMAFEIVKQMKDLGLKPKLRSYGPALTAFCNGGNVEKAFEVEAHMLESGITPEEAELETLLRASVVGRRGDKVYYLMHKFRTTVRQVSPSTAELFEVWFRSPTASKVGKRKWDTGAIVKAIENNGGGWHGFGWLGRGKWTVTRSNINKNGVCLACGEKLAIIDLDPKETEDFATFVAKLAIKRERNSNFENFQKWLKKHGPFEAVVDAANVGLFGHRHLSLSKACILLRFTSRKWPLIVLHNKHLTGEHMKKPGNHKLVEKWKQANSIYATPTGSNDDWYWLYAAIRCNCLIVTNDEMRDHTFQILERNFFPKWKERHQVHFTIEDSCVTFQMPPPYSVVIQESDKGHWHIPVSEEALLEKDRTWLCVTRQNSQAQ

SEQ ID NO: 149 - protein, 461 aa, Artificial Sequence
  mutant Sorghum bicolor _3a
MHMLQAGAPPSEATITSLARVIAAADDPGSSAADEAFELVATMKDKYGLSPRLRSYGPVLAAFRSAGEAAKAYAVEAHMTASGVSPEEPELAALLDVSSRAGDADKVYEYMHKLRQAVDCVSEETAGVVEAWFRSDKAAMAGKSEWNAAQVKDAIVANGGGCHRLGWLGTGPWTMQRVRVGADDQCAGCRYRLACIDIDMEETRKFADSVAGLALERETKTNFSRFQEWLEANKEYQAIVDGANIALYQQNFAEGGFSLTQQLDAVITELRDRYHGKWPLVILHNKRIAKLMENSSNRHLIETWRTNGALYTSPSGSNDDWYWLYAAIKLNCLLVTNDEMRDHIFELLGSSFFPKWKQRHRVKYTFNKGKAVLVMPPSYSSEIQESEMGSWHIPMEEKSGDERGRIWLCIGRGGSCKEHGEVPTTNGVVHEIPPTEASKVVQQRLAENKNETISGKRKDRD

SEQ ID NO: 150 - protein, 384 aa, Artificial Sequence
  mutant Sorghum bicolor _3b
MHPIPAYTVSGSSAGTDAAPYRMPHASSASVSPSPSPSRRRAIPAAASHAEAPLAAARSDKAATAGKSEWNAAQVKDAIVANGGGCHRLGWLGTGPWTVQRVRVGADDHCGGCRYRLACIDIDMEETRRFADSVAGLALERETKTNFSRFQEWLEANKEYQAIVDGANIALYQQNFAEGGFSLTQLDAVITELRDRYHGKWPLVILHDKRIAKLMENSSNRHLIETWRTNGALYTSPSGSNDDWYWLYAAIKLNCLLVTNDEMRDHIFELLGSSFFPKWKQRHRVKYTFNKGKAVLVMPPPYSSEVQESEMGAWHIPMEEKSGDERGRIWLCIGRGGSCKEHGEVPATNGVVHEIPPTEASNVVQQRLAENKDESITGKRKDRD

SEQ ID NO: 151 - protein, 650 aa, Artificial Sequence
  mutant Hordeum vulgare 1
MHSYSSSTATALDDPPPPPSPDAPTPTGQGGDTKAARRRRARESPEGLLKHRLDMCSRDADLATALQLYEAAVDPATAVPLALHHYNCLLYLCSNSGDADAARRGFEIFAAMEAQGVEPNEATLTSLARLAAAVRDPAMAFSVVRRMAAAGIPPRLRSYGPALFAYCDARDANGAAEVEAHMDAGGVVPEETELTALLRVNADIGRADQVYRVLHRTRTLVRQVCQATAQVVEAWFRSDAAAEAGVDKWDARKVREGVVKGGGGWHGQGWLGKGQWDVGQSEMDKDGRCQRCGEKLVCIDIDPSETETFAKSLAELACNREVRDDFVRFQDWLHRHGPFDAVIDAANVGLYKSKAFSFSQVNSVVNGIQRVTKSKKLPLIVLHRSRVNCGPAKTPQNQKLIESWRNAGALYSTPPGSNDDWYWLYAAVSCRSLLVTNDEMRDHLFQLLGTSFFPRWKEKHQVRLTYSGRGPTFHLPPPYSIVIQESEAGSWHVPTTTGDDIESPRQWVCATRKTSERPPSPPPQARATSKTLEGPPSPPPQARATGKTSEGPPSPLPQARATRKTSEGPPSPPPQARTTSKTLERPASSPPQAHAGSKTLDRPPSPLPQARAARKTSGRLPSPPPQASATNKNAERPSPSPKARLSDLGW

SEQ ID NO: 152 - protein, 527 aa, Artificial Sequence
  mutant Hordeum vulgare 3
MGPNSDLSRTLTDCTRRGDAAAAMAAFDAAASGPDDLRLAAHQYNQLLHLLATAPFPGHPAAAARRVFAHMLGAGAAPSEATITSLARVVAADADAEGADEAFALVSTMRDKYGLAPRLRSYSPVLAAFRRAGDAGKAYAVEAHMAASAVSPEEPEVAALLEVSAKAGDADKVYEYMHKLRRAVGCVTEETAEVLEGWFRSEEAAAAGKAEWDACRVKEAIVAKGGGCHQLGWLRTGPWTVQRVRVAADGECGGCGCRLASVDIDMEDTHKFADSISGLALERETKANFSHFQEWLEEHKEYEAIVDGANIALYQQNFSEGGFSLVQLDAVVTELRDRYNGKWPLVVLHNKRIAKLMETPSNRHLIEIWRANGALYTSPSGSNDDWYWLYAAIGLNCLLVTNDEMRDHIFELLGSSSFFYKWKQRHRVKYTFNKGKAVLVLPPPYSSEIQESETGSWHVPIEEKSGDERARTWLCIGRTDLTKLPREPLVANGVAQDLSPSEASNGAGQRQSAEQAAPVTGKRKDRD

SEQ ID NO: 153 - protein, 529 aa, Artificial Sequence
  mutant Oryza officinalis_1
MTASLRRSSLPFARPRRHSTTTTTAETRPKPNESNAARRRRARDSPEGLLKAKLDICSRDNDLPTALTLYEAAISPDSLIPLSVGHYNCLLYLCANAAAASSPDAAHRGFDIFSRMEADGVQPNEATLTIVARLAAARRDPAMAFSIVRRMATAGSAPHLRSYGPALFAYCDAGDADGATEVEAHMDASGVVPEEPELAALLRVNSARGRPEQVYRILHRARVLLRQVADATAQLLESWFASHAASEAGLHDWDATKVKEGLRNGGGGWHGQGWLGKGQWTVGRSEMDKDGTCQRCGEKLVCIDIDPSETQSFAESVAQIAINRDANFIKFQEWLECHGPFDAVIDAANVGLYNRNSFSFYEVNRVVNGIQRITKSKKLPLIILHKNRVNGGPAKLPQNQKLLECWQRAGALYATPPGSDDDWYWLYAAVICRSLLVTNDEMRDHLFQLLGTSFFPRWKEKHQVRLTFSGRGWNFHLPPPYSIVIQESEEGSWHVPTTNGDDIEKPRQWICATRKISGKSSQAFARAVG

SEQ ID NO: 154 - protein, 510 aa, Artificial Sequence
  mutant Manihot esculenta 1
MESSALAMDKVSNKSKRKARQESPEGVLKLKLDMCSKHGDVVQALHLYDEARTNGVQLNQHHYSVLLYLCSSGSSVKLNGNVVDANASSLYYKRGFEIFQQMIIDKVAPSEATFTNAARLALALEDPEMAFDLVKQMKGFNILPKLRSYGPALFGFCSKGMADRAYEVDAHMAESGVMPEEPELSALLKLSADVKRADKVYDTLHRLRAIIRQVTDSTLGIIEDWFNSEDASKIGEENWDTSKVRKGILMGGGGWHGQGWLGSGQWRAVRTQIDEKGGCHSCGEKLVCIDIDPRETENFATSLSNLACQREVRTDFVRFQEWLQQHGPFDAVVDGANLGLVNQRTFSFYQLNSVVGKLREMSPSKRLPLIILHKRRVTGGPATNPKNKMLLEFWKKSGALYTTPAGSNDDWYWLYAAVTCNCLLVTNDEMRDHLFQLLGTSFFPRWKEKHQVRISVSRSGLTLQMPPPYSIVIQESENGSWHVPTIAGDDLETPRQWLCATRAKNKVIPF

SEQ ID NO: 155 - protein, 738 aa, Artificial Sequence
  mutant Manihot esculenta 2
MASFPFNTLQPKHHLSTTLCKYPLSLNTLNFHCSFHFLTFYPFEHKPSFVRRASGNDINIKTKLSTANHENPTKTKNLRIRKSSSTVDERVGRKFVNNLVESVIEESIDERFTKNRNGRKDMGFRKRRDIDSGDLSTRFRDGNKKREALEIMDLQAINGIAKGSKENKPDSVEVKFRLDLDMCSKKGDVMGAIQLYDLALKEGIKMEQYHHAVLLYLCSSAAVDEDIKKYALRRGFEIYEKMCTDEVPVNEATLTAVARMAMSMGNGDMAFDMVKRMKPLGLNPRLRSYGPALSTFCNNGDVDKAFAVEKHMLEHGVHPEEPELEALLRVSVEAGKGDKVYYLLHKLRTTVRKIPPCTADIVVRWFKSKAASRVGKTKWNKRVIKEAIENGGGGWHGRGWLGKGKWNVSFTSIGPDAFCRCCGEKLATIDLDPAETQNFAESVASIAIKREKNSSFEKFQKWLNYYGPFEAVIDGANVGLLSEKIFIPSKINAIANGIRQQLPSKRWPLIVLHNRRVSGHNMNEPANKALIEKWKNADALYATPTGSNDDWYWLYAAIKFKCLLVTNDEMRDHTFQLLGNDFFPKWKERHQVHFNFSDVGPVFHMPPCFSVVIQESERGNWHIPIATDDDYEPERNWLCITRANSSVARHDSMTTRTEDSQSVDHSNDKQAMSPMQNSLKEKQEYNQCSLEVLSNSPQAVYKNLRNVLLASGFTERRTILQEIEAAEKLGGCVIDFQI

SEQ ID NO: 156 - protein, 551 aa, Artificial Sequence
  mutant Manihot esculenta_3
MQNKNQTPESQFNYNLNFFSKSKDLRSAVSLYDSAVSSDTRLSQHHFNTLLYLCSISLSDPSTKELALQYGVRVFDHMVANGIKPNEASITAVARLAAAKGDGDYAFDLVKNMGVHNELPRLRTYDPVLLCFCDKLEADKAYEVEVHMESMGVSLEETELAALLKVSAETGNEERFYGYLQKLRKTVRCVREETAKIIEDWFQNFEHNGQELNVGLVREAVTRNGGGWHGIGWIGKGRWVVRRGNVDNDGKCFCCGEHLARIDIDDTETERFAASVAGLAMEREVKAYFNEFQDWLDKHPNYEAIVDGANVGLYQQNFAEGGFSVSQLDAVVKELYGQSGNWPLIVLHNKRVRALLENPSHSKLIQEWIEKEVLYTTPHGSNDDWYWLYAAVKLRCLLVTNDEMRDHIFELLGSNFFLRWKERHQVRYTFMKGNLKLHMPGPFSVVIQESEKGAWHVPIAGDGNEDSKQSWLCITRPSAWGEPGEDAVSMETCENGDSVWNGCKLLSPCKPKCISSCDSEPERQDSFQESDNKPATMTGKRKERSPSPSIS

SEQ ID NO: 157 - protein, 565 aa, Artificial Sequence
  mutant Theobroma cacao 1
MLGVNPYVPSMSMFKKIPFSFIYRNCFHRSLLPFGMCYYHLFLKPVSISNVHVNYFAVDKTRNLSAVATAAKSTVNTSNSTNAMSNSPESVLKYKLDMCSKHGKLVEALRLYEEGRSNGVTLKQHHYNVLLYLCAREASGDGVELKELGLKRGFEIFQKMVGDKVSPNETAFTSMARLAVAREDLDLAFELVKQMKSLGIPPKLRSYGPALFGFCEKGNAEKGYELDAHMAESGVTPEEPELSALLKVSADTKNADKVYDMLQRLRATVRQVSESTFQIIEDWFKSEDAAKVGVESWDVNKIKKGVVDGGGGWHGQGWLGSGRWRVMRTKMTENGVCRCCGEKLVSIDIDPKETENFATKLTELACNREVKADFIRFQEWLQQHGPFDAVVDGANVGLIKADTFNFNQLNNVVNQLRQMSPSKRSPLVILHQGRVTNGPARNPNNRNWLDSWKRAGALYATPAGSNDDWYWLYAAVSCKCLLVTNDEMRDHLFQLLGTSFFPRWKEKHQVRLSMTRLGLSLHMPPPYSIVIQESESGSWHVPTIADDDLLNPRQWLCVGRTRNKS

SEQ ID NO: 158 - protein, 828 aa, Artificial Sequence
  mutant Theobroma cacao 2
MGNSKSKKEIGSGFNSLRSGNEGAERNSLENLFSSVLEGKAERKRYAKDKNARKRDKYFERGREMGSGDSSLRAKDENMGSKQKSSKNVNNLVAKEKVEGKTKDGDGLVKEKRLGKRSKKDQANSPEVHLRVQLDMCSKRGDVMGAIQLYDKALREKIKMGQYHYAVLLYLCSSAAVGVVQPAKSGSGSRPLNMLNVSNEASSMNSMGLGEPIDKDSENSSASELSNPILNNGKLVDSSRSQGNIDKLKVRFSESFCNLDNTFPDKNLNQFSNGSPKPYSRLSEGSSYQKKRDEDHLDIDDKSSSDREDYEIGVSEDVKKYALLKGFEIYEKMCLDNVPMNEATLTAVARMAMSMGNGDMAFDVVKKMNQLGINPRLRSYGPALSVFCNIGDVDKAFEVEKHMLEHGIHPEEPELEALLRVSVEAGRGDNVYYLLHKLRTSVRKVSPSTADKIVKWFESKEASRLGKRTMDQRFIKEAIENGGGGWHGQGWLGKGRWIISHTAVGADALCKCCGEKLALIDLDPVETEKFAESVASIATKREKHFSFQKFQKWLDYYGPFEAVVDAANVGLFSQRRFMPSKVNAVVNGIRQKLPSKKWPLIVLHNKRITGQKMDEPVNKALIEKWKNADALYATPTGSNDDWYWLYAAIKFKCLIVTNDEMRDHTFQLLGNDFFPKWKERHQVHFSFSNAGPVFYMPPPCSVVIQESEKGHWHIPIASELDYDTERTWLCIRRAKSHVVKEDSSTIPEDLQPLDRNKECTRPTIQTEVNTNSLSLKDGNHDKPQKHTEEIYKNIRDILSVPVPSDQCTVLSEIEAAEMLGNCVIDFQI

SEQ ID NO: 159 - protein, 555 aa, Artificial Sequence
  mutant Theobroma cacao 3
MATPSHKGNPTPEANFLYELNSCSKSKDLEAAISLYESAISNKTRLNQHHFNTLLYLCSTISTDPESKSLALTYGFRVFDHMITLNIHPNEASITAIARLAAAKGDGDYAFEMIKKLGDYRVLPRLRTYEPALFCFCQKLEAEKAYEVEADINKMGLSLEEPQIAALLKLSAETGRGEGVYEYLQKLRRGVRWVSEETGKVLEDWFSREGSEVGFEGATYEVSFVKEAVLRNGGGWHGLGWIGKGKWVVRKGKVEPNGRCCCCGERLGCVDIDDVETEKFAQSVAGLAMEREVKANFREFQEWLEQNADYEAIVDGANIGLYQQNFAEGGFSILQLDAVIKEMYGRSGNKWPLIILHNKRVRALLENPSYRKLVEEWMNNGFLYTTPHGSNDDWYWLYAAVKLRCLLVTNDEMRDHIFELLGSSFFLKWKERHQVRYTFPKGILKLQMPPSYSVVIQESEKGSWHVPIVCDGNEESARTWLCITRPGACEDLGKTASNIETCENGNGPCCKSEMSNTGDFEILPSDNRNQASQDFFQMSYAETPSITGKRKERSP

SEQ ID NO: 160 - protein, 508 aa, Artificial Sequence
  mutant Cucumis sativus 1
MASSTSSSNKVSHKLRKKALKEAPESVLKYNLDMCSKYGQVVKALELYDEARSNGIQLNQHHYNVLLYLCSSPSLLETSGANNLSSVVLSRGFEIFQQMMTDKVSPNEATFTSLARIAAARDDPEMAFSLVKQMKDYHIAPRLRSYGPALFGFCRKLMPKEAYEVDSHMLASAVEPEELELSALLKLSSDVKKADKVYELLHRLRRTVRQVSEPTAKVIEDWFNSESASEVGKKHWDVDKVRECIVRRGGGWHGEGWLGSGKWKLVRTGIDDNGVCHSCAQKLVCIDIDPKETEDFASSLTKLANQRVKADFNNFQGWLEKHGPFDAVIDGANVGLVNERQFNFIQLKRAVYQMRELSPSKKMPLIILHKRRITDGPARNPNNMKLIETWKNCGALYATPYSVNDDWYWLYAAVRFKCLLLTNDEMRDHLFQLLGNTFFPQWKEKHQVRLSVSRNGLKLHMPPSYSIVIQESENGSLHVPTTTGDDLETPREWLCATRPTNTSMSGFE

SEQ ID NO: 161 - protein, 682 aa, Artificial Sequence
  mutant Cucumis sativus 2
MEFSATKNRKPSSKPSFSMTQKLNKNGSPHLGHGNETLVKNSVEDLVNLEVDERTRKRFEKGKNARDSSRSVNGMKMGDGISFLKTSTDSASLKVSRDGGKIKEKRKGNQVVEEKGKLLKGNNETPFRANLDMCSKTGDFIGAIKLYEWAQKEGINLEQYHYAVILYLCSSAALDFKKYALETGFEIYEKMCAENIPMNEATLTSVARMAMSMGDGDKAFDMVKQMKPLGLNPRLRSYGPALSTFCKNGKLEKAFSVEKHMLEHGVYPEEPELAALLRVSINASNAEKVYYLLHKLRTSVRQVLPSTADLIITWFKSKDAARVGKVKLDRKIIKKAIGNGGGGWHGLGWLGRGKWSVSSTNVGKDGLCKSCGEKLATIDLDPIETENFAESVAAIVTQREKNSSFQKFQKWLEYYGPFEAVIDAANVGLFSQRKFAPSKVNLIANGIRQKLPSKKWPLIILHNRRITGRKMEEPVNKTLIEKWKNADALYATPTGSNDDWYWLYAAIKFKCLIVTNDEMRDHTFQLLGNDFFPRWKERHQVHFSFSATGPVFHMPPPCSVVIQESENGHWHVPLASEHSYEEDRKWLCITRGNLQSQMARQEPPRKTEPQSLLLNKGNLGTRADVDIKKQPSTQVLTKNSSQDNYKSLKQILSAAVFSDKCNLLKEMEAAEKLGGCTIDFQI

SEQ ID NO: 162 - protein, 524 aa, Artificial Sequence
  mutant Cucumis sativus 3
MQSPEVKFQLDLTDCSRRKDLLSAITLCETAVSEKLKFNQQHFNTLLYLCSTAISDPSLKESAVSFGFRVYNLLQSIGVIPNEATVTAVARLAAAKRDGDSAFELVKTIGKYKVTPRLRTYDPALICFCENLEVDKAYEVEQHMNSAGVELEEPQISALLKLSSDTGKEDKVYEYLHKLRRVVKCVSESTAKIIEGWFCSEKASDIGESTMDIGLIREAILSNGGGWHGKGWIGKGNWVVKRTNVYSSGKCCCCAQQLVGVDISCAETENFAQSLAALAIEREAQPNFISFQEWLEVHNHCDAIVDGANVGLYQQNFADSGFNLSQVEAVVKELCKMSGGKWPLVLWHNKRTRASLDNSSHRKVVEEWIDKGVLYSTPIGSNDDWYWLYAAVKLKCLLVTNDEMRDHIFELLGNDLFLRWKEKHQIRYTFVKGQLRLEMPPPYSVVIQESETGSWHVPIAANDSELERTWLCVTRPGVSAASDVAVNGETCESIEAQGSCASMSVKLLDSSVARKRKERPSSTS

SEQ ID NO: 163 - protein, 552 aa, Artificial Sequence
  mutant Vitis vinifera 1a
MSLLYGCSHHHFKPTTYSPYIKVRIFMNKSAHFSNLALSATNKYIPESSAVAETMSNKARKKARRESPEGVLRFKLDMCSKRGDVVEALRLYDEARSRGVPLSQHHYNVLLYLCSCSGSNGDENVVNLALKRGFEIFKQMGVDGIEPNEATFTSAARLACAMEDPEMAFNLVKQMKSCGIPPKLRSYGPPLFGFCKKGDADRAYEVDAHMMESGVVAEEPELCALLGLSVESRRVDRVYEMVHRLRASVRQVSESTAEVVERWFNSEDAAGVGEENWDVGKVREGVVKGGGGWHGQGWLGKGKWKVVRTEMDEAGVCQSCGEKLVCIDIDPRETENFASSLTKLACQREVKADFVQFQEWLQRHGPFDAVVDGANVSLINQKSFSFFELNSVVNRLRQISPSKRLPLVILHRSRVTGGPAQNPNNKKLIESWKKSGALYATPAGSNDDWYWLYAAVNCNCLLVTNDEMRDHLFQLLGTSFFPRWKEKHQVRLTITRRGPVLHMPPPYSIVIQESEQGSWHVPTVTGDDLETPRQWLCATRTRKNHRHPQHLE

SEQ ID NO: 164 - protein, 552 aa, Artificial Sequence
  mutant Vitis vinifera 1b
MPLLHGCSHHHFKPTTYSPYIKDRIFMNKSAHFSNLALSATNKYIPESSAAAKTMSNKARKKARRESPEGVLRFKLDMCSKRGDVVEALRLYDEARSLGVPLSQHNYNVLLYLCSCSGSNGDENVVNLALKRGFEIFKQMGVDGIEPNEATFTSAARLACAMEDPEMAFNLVKQMKSCGIPPKLRSYGPPLFGFCKKGDANRAYEVDAHMVESGVVAEEPELCALLGLSVESRWVDQVYEMMHRLRASVRQVSESTAEVVERWFNSEDAAGVGEENWDVGKVREGVVKGGGGWHGQGWLGKGKWKVGRTEMDEAGVCQSCGEKLVGIDIDPRETENFASSLTKLACQREVKADFVQFQEWLQWHGPFDAVVDGANVSLINQKSFSFFELNSVVNCLRQISPSKQLPLVILHRSRVTGGPAQNPNNEKLIQSWKKSGALYATPAGSNDDWYWLYAAVNGNCLLVTNDEMRDHLFQLLGTSFFPRWKEKHQVRLTMTRRGPVLHMPPPYSIVIQESEQGSWHVPTVIGDDLETPRQWLCATRTRKNHRHPQHLE

SEQ ID NO: 165 - protein, 737 aa, Artificial Sequence
  mutant Vitis vinifera 2
MCPSPFNAFKFHHSSHFLTFSSPKHTPPPRKSALLIVRPHVGHLYAKLCTADHEPSTADMGGRTGKETGSGFSSYGSKGERVGRKSVKTHVGWAVEEKNEKRFTRERYSKKRLDSRRNGGTSSKFPSLKSESKNLVNKSLKANEKEEEKSKKGDADKVREEMEKGSKKNKVDSQEGLLRVGLEMCSKNGDVMGALELYDSALREGIELGQYHYTVLLYLCSSAALDFKKYALRRGFEIYEKMCLEKVPMNEATLTSVARMAMSMGNGDMAFDMVKQMKPLGINPRLRSYGPALSAFCNNGDIEKAFGVEEHMLEHGVYPEEPELEALLRVGIEAGKSDKVYYVLHKLRTSVRQVSHSTANLIEKWFKSNAAAAAGKGNWDQRLISEAIVNGGGGWHGQGWLGKGKWNVSHTNVGADGLCLCCGEKLATIDLDPTETEKFAESVASIAIKREKNSSFQKFQKWLDYYGPYEAVVDAANVGLFSQRRFIPSKVNAIVNGIRQMLPSKKWPLIILHNKRITGKKMDEPANRALIEKWKNADALYTTPTGSNDDWYWLYAAIKFKCLIVTNDEMRDHIFQLLGNDFFPKWKERHQVHFSFSDSGPVFHMPPPCSVIIQESENGHWHIPVASEHDSEGERTWLCVTRANSQMAKQSPSPRNKESQYPCYDKRRVRSDTQTEIHKELSSSNHRNQEKSKAPPQEIYRNLRNILSASIFPTHSTVLSEIEAAEKLGNCIIDFQI

SEQ ID NO: 166 - protein, 526 aa, Artificial Sequence
  mutant Vitis vinifera 3
MDLSGAVALFESAVSQNFRLIHYHFNALLYLCTISIDEPSSKALALDYGFRIFDHMVNSGVTPNEATITAVARLAAAKSDGDLAFEVVRTMGKYELSPRLRTYGPALYWFCANLEGEKAWAVEEHMVSMGVHPEEPELAALLKVSAEMGRGDKVYAYLHKLRTAVRSVSESTAEIIEGWFCGEAASEVGGVDCCLGAIEEVALKNGGGWHGQGWIGKGKWLVCRAKVDSSGQCGSCREQLATVDIDRAETETFLESVAAMAMEREVRSNFREFQDWLDKHADYEAIVDGANIGLYQQNFANGEFSIPQLDAVVKELYDRSQKKRPLVILHNKRFRKLSENASNRKLLQEWLTQGVLYTTPNGSNDDWYWLYAAVKLKCLLVTNDEMRDHIFELLGSSFFLKWKERHQVRYTFVKGNVKLLMPPSYSLFIQESVKGTWHVPVASESSDESLRTWHCITRPSSHELNGKASVNLETCEIDRQEQCDFKLSSCKSEGLRNGSCENKTTTMTGKRKDRSPSPSPSPMQRH

SEQ ID NO: 167 - protein, 530 aa, Artificial Sequence
  mutant Glycine max 1a
MTAATNFSITSLARTPKSRDEGTTTIVKLSSKARRKAFYESPEGVLLRKLNECSKDGNVAQALCHYDEARKLGVLLNLDHYNKLLYLCSIESAAGFPNLGLKRGFEVFQQMLNDRVQPNEATFTNAARLAAANEDPDMAFELLKQMKNVAIAPKLRSYEPALFGFCKRGDAEKAYLVDADMVESGIVAEEPELSALLEVSVNAKKEDKVYDILHRLRSTLRQVSESTLGIVEDWFNSEYAAKIGKEKWDVKKVREGIAQGGGGWHGQGWLGSGRWKVANTQVNEDGVCPLCGEKLVSIDIDPKETENFAASLSKLACQKEAKANFVHFQTWLEQHGPFDAVVDGANVGLANGHNFSFSQLNTVVEQLRQISPSKRLPLIILHISRVRGGPAQNPKNMRLIENWKKNGALYATPQGSNDDWYWLYAAVSCKCLLLTNDEMRDHLFQLLGSNFFPRWKEKHQVRTSASTCGHSIIMPPRYSIVIQESANGSWHVPTVTTDDHEIPRKWLCATRSRKDSLHNLWTSSSKSDCT

SEQ ID NO: 168 - protein, 530 aa, Artificial Sequence; identical to SEQ ID NO: 167
  mutant Glycine max 1b

SEQ ID NO: 169 - protein, 651 aa, Artificial Sequence
  mutant Glycine max 2
MAGISSTSSSSEVSERVKKKKKKKKNKDKDCPEVKLKNALDMCSKRGDVMGALSLYDSAISEGVKLGQHHYTVLLYLCSSAAVGVVRPAKSGSGARTLNSHVYSNEVPNEGTHFDLDGKAELNSDLNSTEKDEILLVSEDVKRYALQRGFEVYQNMCLDKVQMNEAALTAVARMAMSMGDGDRAFEMVRQMKDLGISPRLRSYGPALFTFCNNGEIDKAFAVEKHMLQHGVYPEEPELEALLRVSVGAGNSDKVYYVLHKLRSIVRKVSPTTSSLIVDWFKSKQASRVGKRKWDERLIREAIENNGGGWHGQGWLGKGKWEAVHTTIGKDGMCKCCQVQLTTIDLDPVETENFAKSVASLAVMREKGSNFQKFQKWLDYSGPFEAVVDAANVGLFGQGRFMPHKINAVANEIRQRLPSKKFPLIILHNKRIKGDKMDEPINRALIDKWNNADALYATPTGSNDDWYWLYAAIKFRCLLVTNDEMRDHLFQLLGNDFFPKWKERHQVRFSFSDTGSPVFHMPPPCSVVIQESEEGHWHIPIDAELNDESERRWLCITRAKLDVVSKDSSTSKDSKPLQKGECARSATRNASAKESQHQNLVNHKEKKETPQELYKNVRDIFLESVSSDKNNSILSDIEAAELIGGCTIDFQI

SEQ ID NO: 170 - protein, 520 aa, Artificial Sequence
  mutant Glycine max 3a
MGCRNPETKFQFELNSCSKAKDLRGAISLYDDAVSNNTRLNQHHFNALLYLCSNSVADPSLKPTALDYGFRAFRHMSALAVLPNEATVTAVARLAAAKGDADYAFELVKSMGKNYNNALPRLRTYDPALFCFCEMLDADKAYEVEEHMNGVGVSLEEAELAALLKVSARCGRVDKVYEYLHRLRSSVRCVSESTAVVIEEWFRGSKASEVGEAEFDAGRVKEGVLRNGGGWHGQGWVGKGDWVVSRTSVVADGHCCCCGQQLVCVDIDDVETEKFAGSVAALAFEREVKANFSEFQAWLEKHASYEAIVDGANIGLYQQNFADGGFNISQLDDVVKELYNRSGKKWPLVVLHNKRLRGLMENPSSRRLVEEWMKNGVLYTTPNGSNDDWYWLFAAVKLRCLLVTNDEMRDHIFELIGSNFFNQWKERHQVHYTFVKGNLKLQMPPSYSLVIQESEKGYWHVPLVSGTSCESTRCWLCITRPSGHDAVATVSNGVSSLDSQVDENSATSIAGKRKERSPPS

SEQ ID NO: 171 - protein, 520 aa, Artificial Sequence
  mutant Glycine max 3b
MGSQNPEAKFQFELNTCSKAKDLRGAISLYDDAVSNNTRLNQHHFNALLYLCSNSVADPSLKPTALDYGFRAFCHMSALAVLPNEATVTAVARLAAAKGDADYAFDLVKSMGKNYNNALPRLRTYDPALFCFCEMLDADKAYEVEEHMSGVGVSLEEAEVAALLKVSARCGRADKVYEYLHKLRSSVRCVSESSAVVIEEWFRGSKSSEVGEVEFEAGQVKEGVLRNGGGWHGQGWVGKGDWVVSRTSVGADGHCCCCGEQLVCVDIDDAEREKFAGSVAALAFEREVKANFSEFQAWLEKHASYEAIVDGANIGLYQQNFADGGFSISQLDDVVKELYNRSGKKWPLVVLHNKRLRGLMENPSSRRLVEEWMNNGALYTTPNGSNDDWYWLFAAVKLRCLLVTNDEMRDHIFELIGSNFFNQWKERHQVHYTFVKGNLKLQMPPSYSLVIQESEKGYWHVPLAPGTSCESTRCWLCITRPCGHDVVATVSNGVSSLDSQVDENNATSVTGKRKERSPPS

SEQ ID NO: 172 - protein, 521 aa, Artificial Sequence
  mutant Prunus persica_1
MSMDNFSMDKRLHLCTLALSNDSPSRSASAPLVSNKSKKKARRESPEGVLRHKLDMCSRQGHLVEALRIYDEARSRGLPLSLHHYNVLLYLCSSNGGADDDGVGLKRGFEIFRQMVDDKVVPNEATFTSAARLAAAAEDPEMAFHLVKQMKGLGIPPKLRSYGPALFGFCKKGEADRAYEVDAHMVESKVIAEEPEISALLKVSSDSSKGDKVYEMLHRLRISVRQVSESTSGVVEEWFMSEEAANVGMESWDVEKVREGVVRGGGGWHGQGWLGSGNWRVVRTQMDEAGTCSCCGQKLVSIDIDPKETENFATSLNKLASQREVKADFFQFKEWLQKHGPFDAVIDGANVGLINLHNFSFSQLNTLVNRLRQMSPSKRLPLVILHTNRVTGGPAQNPNNKKLLESWKKAGALYATPAGSNDDWYWLYAAVNSKCLLVTNDEMRDHLFQLLGTNFFPRWKEKHQVRMSVSRQGLALHMPPPYSIVIQESEDGRWHVPTTIGDDIETPRQWLCATRATTNTK

SEQ ID NO: 173 - protein, 826 aa, Artificial Sequence
  mutant Prunus persica_2
MALNSFKFHCPSHFLTFSPPKQTLELKHTLQLYPLPVVRENISHIVAKLSTTYREPYIKTKSPGTGTEFSSLKSTEERVGKKSVKNHVGSVEEKKAEDRFSKDRNTRKNPGFRKRRDDNEHSSRRLKDENKVNFSGKRNDKQAGEEKRGKGSKKYDVDAPEVKMRIGLDMCSKRGDVMGAIKFYDLAQREEIKLEQYHYTVLLYLCSSAAVGVVRPAKSGSGSRTLDTLDSSASEETRVNSMELGSGNWDGRGLNTSTLDTEQLVDTNGSNGEKMGFDDLDGTSDEKENLAWFSNGFVKRNSRLLDGLNYPTKGGDDSSNLKDGSIKQEDNRIRVSEEVKKYALQRGFEIYEKMCLDNVPMNEAALTSVARMAMSMGDGDMAFDMVKQMKSLGINPRLRSYGPALSAFCHSGDIDKAFAVEKHMLDHGVYPEEPELEALLRVSVGVGKGDKVYYMLHKLRTSVRRVSPSTADLIMNWFHSKEAARVGKIKWDPRLIREAIENGGGGWHGQGWLGKGKWSVLRTTIGADGLCKCCGEKLATIDLDPVETENFAESVASIAIKREKNSSFQKFQKWLDYYGPFEAVVDGANVGLFSQKKFIPSKVNAVVNGIRQKLPSKRWPLIVLHNRRISGGKMDERVNRALIEKWQNADALYATPTGSNDDWYWLYAAIKFKCLLVTNDEMRDHIFQLLGNDFFPRWKERHQVHFSFSDAGPVFHMPPPCSVVIQESEEGHWHIPVVSEHDCEAERTWLCIMRSKSRLERNDSATRPEGNSECYQFMKYTKHQPREFFENIKDILSGSMISDCHSIVPDIATAEKIGGCVIDFQI

SEQ ID NO: 174 - protein, 543 aa, Artificial Sequence
  mutant Prunus persica_3
MQTPETQFHSSLTLCSKHKDLPSAISLYESAVSQKTHFNHHHFNTLLYLCSNSVSDPSLKQLALDNGFRVFNQMLSIGTLPNEATITAVARLAAAKGDGDYAFGLVKGMDKYNVLPRLRTCDPALFCFCEKLEAEKAYEVEEHMGMVGVSLEEPEIAALLKVSAETGNGERVYGYLHKLRNVVRCVGESTAKIIEDWFLGGVACELGEANWDSGGVKEAVLRNGGGWHGQGWIGKGVWDVRRANADMSSSQCCSCGERLVCVDIDCGETQRFAESVAALAMEREVKSNFSEFQDWLDKHAEYEAIVDGANIGLYQQNFADGGFSLSQLDAVVKELYNKSGEKWPLVVMHNRRFRGLVENPSHRKLIEEWMDKGILYATPSGSNDDWYWLYAAVKLKCLLVTNDEMRDHIFELLGSSFFLKWKDRHQVRYTFVKGNLQLQMPPPYSSVIQESEIGSWHVPVADDSCQEPARTWLCITRPSVSKASGEVSHNLETSRTGGVCRNLESLNSCTTEFVASHNEKTTVVTGKRKERSPSPSQLNLSSA

SEQ ID NO: 175 - protein, 485 aa, Artificial Sequence
  mutant Malus domestica 1
  misc_feature (227)..(227): Xaa can be any naturally occurring amino acid
  misc_feature (303)..(303): Xaa can be any naturally occurring amino acid
  misc_feature (427)..(427): Xaa can be any naturally occurring amino acid
  misc_feature (446)..(446): Xaa can be any naturally occurring amino acid
  misc_feature (474)..(474): Xaa can be any naturally occurring amino acid
  misc_feature (480)..(480): Xaa can be any naturally occurring amino acid
MAMKKARRESPEGVLRHKLDMCSRHGQLVQALSLYDEARSNGVPLSLHHYNVLLYLCSSNGGGDDGDMGLKRGFEIFRQMVEDKVVPNEATFTSAARLAIAGEDPEMAFHLVKQMKGLGFPPKLRSYGPALFEFCKKGEADRAYEVDAHMVESGVVAEEPEITALIKVSSDSSRGDKVYEMLHRLRTTVRQVSESTYGVVEEWFKSEEAAKVGVETWDVNKVREGVXRGGGGWHGQGWLGSGNWRVERTQMDEVGTCSCCGEKLVSIDIDPKETENFATSLSKLASQREVRGDFIRFQEWLQXHGPFDAVVDGANVGLVNQHNFSFFQLDTLVNRLRQMSPSKRLPLVILHQNRVTGGPAQNPNNKRLLESWKKSGALYSTPVGSNDDWYWLYAAVNCKCLLVTNDEMRDHLFQLLGTSFFPRWKEXHQVRLSVSRRGLNLHMPPXYSIVIQEAEDGEWHVPTTTGDDIETPRXWLCATXARNTK

SEQ ID NO: 176 - protein, 747 aa, Artificial Sequence
  mutant Malus domestica 2
  misc_feature (25)..(25): Xaa can be any naturally occurring amino acid
  misc_feature (97)..(97): Xaa can be any naturally occurring amino acid
  misc_feature (213)..(213): Xaa can be any naturally occurring amino acid
  misc_feature (425)..(425): Xaa can be any naturally occurring amino acid
  misc_feature (438)..(438): Xaa can be any naturally occurring amino acid
  misc_feature (452)..(452): Xaa can be any naturally occurring amino acid
  misc_feature (491)..(491): Xaa can be any naturally occurring amino acid
  misc_feature (510)..(510): Xaa can be any naturally occurring amino acid
  misc_feature (574)..(574): Xaa can be any naturally occurring amino acid
  misc_feature (595)..(595): Xaa can be any naturally occurring amino acid
  misc_feature (612)..(612): Xaa can be any naturally occurring amino acid
MAKLSSTTYHEPYTKSQNSGTGSGXEFSSLKSTEQRVSRKPVKNHVGSGVEKNGEDTRKNLVFRKRREGNGPNGPNGPNGHSSRRFRDENAVKSSKXRGSLGVKEGRNKRGGGNQVGGEERRGRGLKKYDADLPEVKMRVGLDMCSKRGDVMGAIRFYDLAQTEEIKLEQYHYTVLLYLCSSAAVGVVRPAKSGSGSRTLDTLDSHSEETRVXSMDTSNLDNEDLDDTCGSNSFDDDSDGTSDENENLAWFSNGFVKRNSRLLDGLNYPTKGGDDSSNVKEGSSKQEDNGIRVSEDVKKYALKRGFEIYEKMCSDNVPVNEAALTSVARMAMSMGDGDMAFDMVRQMKSMGINPRLRSYGPALSAFCHSGDIDKAFAVEKHMLEHGVYPEEPELEALLRVSVGVGKGDKVYYMLHKLRTSVRRVXPSTADLIVKWFLXKEASRVGRTKWDRXSIRDAIENGGGGWHGQGWLGKGKWSVLRTTIGDDGLCKXCGEKLATIDLDPVETENFXESVASIAIKREKNSSFQKFQKWLDYYGPFEAVVDGANVGLFSQKKFVPSKVNAVVNGIRQKLPXKKWPLIVLHNRRITGGRMDEXVNRALIEKWQNADALYXTPTGSNDDWYWLYAAIKFKCLLVTNDEMRDHIFQLLGNDFFPRWKERHQVHFTFSDAGPVFHMPPPCSVVIQESEEGHWHIPVVSEHERESERTWLCIMRAKSRTATKDSAAIPEGDFQGLAICLFLIAQSLLCL

SEQ ID NO: 177 - protein, 542 aa, Artificial Sequence
  mutant Malus domestica 3
  misc_feature (230)..(230): Xaa can be any naturally occurring amino acid
  misc_feature (322)..(322): Xaa can be any naturally occurring amino acid
  misc_feature (335)..(335): Xaa can be any naturally occurring amino acid
MQTPEAQFHSSLTLCSKHKDLPTAISLYESAVSQNTRLNHHHFNTLLYLCSNSVADPSIKQLALENGFRMFDHMLSIGVLPNEATITAMARLAAAKGDGDYAFGLVKGMEKYKIFPRLRSYDPALFCFCEKLEAEKAYEVEEHMGMVGVSLEEPEIAALLKVSAETGNGERVYGYLHKLRNAGRCVSESTAKNIEDWFCGGAACEVGEVNWDSVRVKESVLRNGGGWHGXGWIGKGVWDVKRTNVDLSSSQCSSCGERLVCVDLDCAETERFVKSVAALAMEREVKSNFSEFQDWLDKHAEYEAIVDGANIGLYQQNFADGXFSLTQLDAVVKEXYNRSGGKWPLVVMHNRRFRGLVENPSHRKLFEEWMGKGILYATPSGSNDDWYWLYAAVKLKCLLVTNDEMRDHIFELLGSSFFLKWKERHQVRYTFAKGNLKLQMPPAYSSVIQESDNGSWHVPVADESCQEPGRTWLCITRQSVSKACGEVSQKLASSRNGGICDNHELRSCTSDSVASHNDKTTVVTGKRKERTPSPSHLNISPA

SEQ ID NO: 178 - protein, 545 aa, Artificial Sequence
  mutant Fragaria vesca 1
MIPLPFLSRTSRRFFRPIPHYPKPQPSPISTHTFSMNQRLNNSTLALSRDSPPSPAAPSVSNKARKKARRDLPEAVLKHKLDMCSRHGQVVEALRIYDEARTNGVPLSLHHYNVLLYLCSCDGEDADVGLGRGFEIFRQMVEDKVVPNEATFTNAARLAAASADPEMAFGLVKQMKVFGIEPKLRSYGPALFGFCKKGEAERAYEVDAHMVECGVVAEEAEISALLKISSEMGKGEKVYEMMQRLRSGVRQVGESTAEVVEEWFKSKEAGRVGVERWDVKKVREGVVRGGGGWHGQGWLGSGEWKVVRTQMDEAGTCAGCGQKLVCIDIDPKETEDFALSVTKLANQREVRNDFAQFQEWLQRHGPFDAIVDGANVGLSNQHYFSFIQLNTVVNRLQKLSPANRLPLVILHKSRTIGGPAQTPKNKALLESWKKSRALYATPPGSNDDWYWLYAAVSCKSLLVTNDEMRDHLFQLLGTNFFPRWKEKHQVRVSVSKLGLNLHMPPPYSIVIQESEDGSWHVPTTTGDDIETPRQWLCATRARNTK

SEQ ID NO: 179 - protein, 697 aa, Artificial Sequence
  mutant Fragaria vesca 2
MTYHEPNSKTLKNSATEKPVKNNGSSVVEKKSEKTRFIKQKSTRKEGVWFKGESKERKKRGSSDGDQVGEEKKGRFSKKNKVKVNVDLPEVKMRVGLDMCSKRGDVMGAIKYYDLAQTEEIQLGQYHYTVLLYLCSSAAVGVVRPAKSGSGGTRTLDTVDSSGEKTVELSKVRDSESGNWDDTSGSDESAEKMEVSPGNRFDDDVDGASNEKRNLAWFSNGFVKRNSRLLDGLNNPTKVGDDGTGLEDGNVKQESNEIRVSEDVKKYALQRGFEIYEKMRLDGVAMNEAALTSVARMAMSMGDGDMAFDMVKQMKSMGINPRLRSYGPALSAFCSSGNIDKAFAVEKHMLEHGVYPEEPELEALLRVSVGARKGDKVYYMLHKLRTSVRRVSPSTADLIVKWFESKEASRVGKTKWDERLIRQGIENGGGGWHGQGWLGKGKWSVLRTTIGSDGLCKCCGGKLATIDLDPVETENFAESVASIAIKREKNSSFQKFQKWLDYYGPFEAVVDGANVGLLSQKIFIPSKVNAVVNGIRQKLPSKRWPLIVLHNRRITGGRMDERVNKALIEKWQNADALYATPTGSNDDWYWLYAAIKFKCLLVTNDEMRDHTFQLLGNDFFPRWKERHQVHFNFSEGGPVFHMPPPCSVVIQESEEGHWHIPVVSEHGYEAERMWLCIMRAKSREARKDSATRPKGNL

SEQ ID NO: 180 - protein, 506 aa, Artificial Sequence
  mutant Fragaria vesca 3
MAISLYESAVSRNTRLNQHHFNTLLYLCSNSVTDPALKQSALEYGFRMFDHMSLTEVVPNEATITAVARLAAAKGDGDYAFELVKGMEKYNVLPRLRTCDPALFCFCEKLEADKAYEMEEHMNKVGVSVEEPEISALLKVSAEMGRGERVYDYLHKLRNTVRCVSESTAKIIEDWYRDGRASEVGEVSWDSGRVKEVVLRNGGGWHGQGWIGKGDWDVQRANVDSESKCCSCGEHLVCVDIDCAETDRFAQSVAALAMEREVRLNFSEFQDWLDKHADYEAIVDGANIGLYQQNFADGGFSLPQLDAVVKELYNRSGEKWPLVVLHNRRFKSLVENPSHRKVVEEWMDKGILYTTPSGSNDDWYWLYAAVKLKCLLVTNDEMRDHIFELLGSSFFLKWKERHQVRYTFIKGNLKLQTPPPYSSVIQESESGSWHVPLADDSCEEPARTWLCITRPSVTKASSGVLISQSALPNSCTSQFVTSHNDKTTTKTGKRKERSPSPSHLMI

SEQ ID NO: 181 - protein, 533 aa, Artificial Sequence
  mutant Citrus clementina_1
MADLTTGLCTLAFSKKSTVNESSAPNTGTMSNKSKKKARRESPEGVLRHKLDMCSKRGDVFEALRLYDDARSNGITLSQHHYNVLLYVCSCKCGSESSENGDRETDLNLGLKRGFEIFQQMITDKVDPNEATFTSVARLAVAKEDPEMAFDLVKQMKSFGIPPKLRSYGPALFGFCKLGNTDKAYEVDAHMGESGVVPEEPELSALLKLSVDAKKVDKVYEILHRLRTLVRQVSESTFKIIEDWFDSVDAAEIGVLNWDVSKVREGIVRGGGGWHGQGWLGSGKWRVERTQIDENGVCCSCNERLVCIDIDPRETENFASSLSNLACQREVRSDFNKFQEWLGRHGPFDAVIDGANVGLVNQHNFSFYQLNTVVNRLRQMSPSKRMPLVILHKGRVSGGPAQIPKNKKLLDIWRDGGALYTTPPGSNDDWYWLYAAVNCKSLLVTNDEMRDHLFQLLGTSFFPRWKEKHQIRLSVSRDGLNLLMPPPYSIVIQESENGSWHVPVITGDDLEAPRQWLCATRARVKSLHSLFSN

SEQ ID NO: 182 - protein, 793 aa, Artificial Sequence
  mutant Citrus clementina_2
MKGTASGASSLGTRDKRVDSAGEEKDGKRLTKDNNSRKNFAFLKSREMSSGNSSLRSKDKKIGIKSSKTVNREVDNQKMEQRTNDSGQYKVRGITDEKGSKKSKKDRSEQFQLRVELDMCSKRGDVMGAIRLYDKAQREGIKLGQYHYNVLLYLCSSAAVGVVKPAKSGSGMRTLDTFEVSTMNSTELGDSRDMDNNGQLDYGSSPMIDKLESNSSYRFDDLDSTFNEKENLGQFSNGHMKLNSQLLDGRSNLERGPDDQSRKKDWSIDNQDADEIRLSEDAKKYAFQRGFEIYEKMCLDEVPMNEASLTAVGRMAMSMSDGDMAFDMVKRMKSLGINPRLRSYGPALSVFCNNGDVDKACSVEEHMLEHGVYPEEPELEALLRVSVEAGKGDRVYYLLHKLRTSVRKVSPSTADVIAKWFNSKEAARLGKKKWNESLIRDKMENKGGGWHGLGWLGKGKWIVSHTTVGGDALCKCCGEKLAIIDLDPIETEKFAESVASIAIKRERNSSFQKFQKWLDYYGPFEAVVDAANVGLYSQRNFKPARVNAVVNGIRQKFPSKKWPLIVLHNRRITGHKMDQPVNRALIEKWKNADALYATPTGSNDDWYWLYAAIKFKCLLVTNDEMRDHTFQLLGNDFFPRWKERHQVRFSFSDAGPEFYMPPPCSVVIQESEKGNWHIPIASKQDYDDEERRWLCVTRANSHMNRQNSYSSPKDLQPLDHNKGQASSSTRADAKTKSHSSNDSPSVNTKRPARKMYKNLKNILSASVLSNHQSVLSKIEAAEELGDCVIDFEI

SEQ ID NO: 183 - protein, 456 aa, Artificial Sequence
  mutant Citrus clementina_3
MESAHSQNLRLSLHHFNALLYLCSDSATDPSSKDSALRHGFRVFDQMLSNNVIPNEASVTSVARLAASKNDGDYAFVLIKRMNNEFNVVPRLRTYDPALFCFCENLEAEKAYEVEEHMGLMGLSLEQQEIAALLKVSAETGRVEKVYQYLQKLRSTVRCVNEETGKIIEDWFSGQKVNGVSCDLGLVKNAVLKNGGGWHGLGWIGQGKWVVKRGSVDESGKCCSCGDQLACVDIDDAETERFAQSVAALAMEREVKANFSEFQDWLEKNANYEAIVDGANIGLYQQNFTEGGFSVPQLDAVVKKLYERSGNKWPLVILHNKRLRSLWENPSHRNLVEEWNEKGVLYMTPHGSNDDWYWLYAAVKLRCLLVTNDEMRDHIFELLGSNFFLKWKERHQVHYTFVKGNLKLQMPPPYSSVIQESEKGSWHVPILVKGNSSQTWLCITRPNVCESRDEAQ

SEQ ID NO: 184 - protein, 533 aa, Artificial Sequence
  mutant Citrus sinensis_1
MADLTTGLCTLAFSKKSTVNESSAPNTGTMSNKSKKKARRESPEGVLRHKLDMCSKRGDVFEALRLYDDARSNGITLSQHHYNVLLYVCSCKCGSESSENGDRENDSNLGLKRGFEIFQQMITDKVDPNEATFTSVARLAVAKEDPEMAFDLVKQMKSFGIPPKLRSYGPALFGFCKLGNTDKAYEVDAHMGESGVVPEEPELSALLKLSVDAKKVDKVYEILHRLRTLVRQVSESTFKIIEDWFDSVDAAEIGVLNWDVSKVREGIVRGGGGWHGQGWLGSGKWRVERTQIDENGVCCSCNERLVCIDIDPRETENFASSLSNLACQREVRSDFNKFQEWLGRHGPFDAVIDGANVGLVNQHNFSFYQLNTVVNRLRQMSPSKRMPLVILHKGRVSGGPAQIPKNKKLLDIWRDGGALYTTPPGSNDDWYWLYATVNCKSLLVTNDEMRDHLFQLLGTSFFPRWKEKHQIRLSVSRDGLNLLMPPPYSIVIQESENGSWHVPVITGDDLEAPRQWLCATRARVKSLHSLFSN

SEQ ID NO: 185 - protein, 793 aa, Artificial Sequence
  mutant Citrus sinensis_2
MKGTASGASSLGTRDKRVDSAGEEKDGKRLTKDNNSRKNFAFLKSREMSSGNSSLRSKDKKIGIKSSKTVNREVDNQKMEQRTNDSGQYKVRGITDEKGSKKSKKDRSEQFQLRVELDMCSKRGDVMGAIRLYDKAQREGIKLGQYHYNVLLYLCSSAAVGVVKPAKSGSGMRTLDTFEVSTMNSTELGDSRDMDNNGQLDYGSSPMIDKLESNSSYRFDDLDSTFNEKENLGQFSNGHMKLNSQLLDGRSNLERGPDDQSRKKDWSIDNQDADEIRLSEDAKKYAFQRGFEIYEKMCLDEVPMNEASLTAVGRMAMSMGDGDMAFDMVKRMKSLGINPRLRSYGPALSVFCNNGDVDKACSVEEHMLEHGVYPEEPELEALLRVSVEAGKGDRVYYLLHKLRTSVRKVSPSTADVIAKWFNSKEAARLGKKKWNESLIKDTMENKGGGWHGLGWLGKGKWIVSHTTVGGDALCKCCGEKLAIIDLDPIETEKFAESVASIAIKRERNSSFQKFQKWLDYYGPFEAVVDAANVGLYSQRNFKPARVNAVVNGIRQKFPSKKWPLIVLHNRRITGHKMDQPVNRALIEKWKNADALYATPTGSNDDWYWLYAAIKFKCLLVTNDEMRDHTFQLLGNDFFPRWKERHQVRFSFSDAGPEFYMPPPCSVVIQESEKGNWHIPIASKQDYDDEERRWLCVTRANSHMNRQNSYSSPKDLQPLDHNKGQASSSTRADAKTKSHSSNDSPSVNTKRPARKMYKNLKNILSASVLSNHQSVLSKIEAAEELGDCVIDFEI

SEQ ID NO: 186 - protein, 456 aa, Artificial Sequence; identical to SEQ ID NO: 183
  mutant Citrus sinensis_3

SEQ ID NO: 187 - protein, 532 aa, Artificial Sequence
  mutant Populus trichocarpa 1a
MKHIKDSNFIGAHNLFMKKKATFCNSAISATSQSDEKAVGGNVVSKRLKKKARRDAPEGVLRFKLDMCSKVGDVVEGLRLYDEARRNGVELNQHHYNVMLYLCSQNRGENGSDLKLACKRGFEIFQQMIIDKVPPNEATFTNAARLASVMEDPEMAFDLVKQMKGFGIMPKLRSYGPPLFGFCKKGMVDKAYEVDAHMIESGVVAEEPELSSLLKLSADVNNADKMYELLHRLRTSVRQVMESTVGVIEDWFKSEHAAKIGKGDWDVIKVKEGVVRGGGGWHGQGWLGHGQWRVVRTQMDKKGVCGSCGERLACIDIDPRETENFAISLSKLAFGREVKADFIQFQEWLQQHGPFDAVVDGANVSLINQQTFNFSQLNNVVNRLHDMSPSKKFPLVILHKSRVNGGPAQSPYNKKLLERWKNSGALYATPAGSNDDWYWLYAAVSCKCLLVTNDEMRDHLFQLLGTSFFPRWKEKHQVRLSVSRSGIALHMPPPYSIVIQESENGGWHVPTTTGDDLETPRQWLCATRPVKR

SEQ ID NO: 188 - protein, 496 aa, Artificial Sequence
  mutant Populus trichocarpa 1b
MNEKAVGGNVMSLREKKKARREAPEGVLKFKLDTCSKRGDVVEGLRLYDEARKNGVELNQHHYNVLLYLCSQNGGENVSDLRKQGFEIFQQMIIDKVPPNEATFTNAARLASAMEDPEMAFDLVKQMKGFGILPKLRSYGPPLFGFCKKGMADKAYEVDAHMIEYGVVAEEPELSALLKVSADVNNADKVYELLHRLRTSVRQATESTVGIIEDWFKSKHAAKTGKENWDVRKVKEGVARGGGGWHGQGWLGCGQWRVVRTQMDKEGVCGSCGERLACIDIDPRETEDFAISLSKLALGREVKADFIRFQDWLQRHGPFDAVVDGANLSLINQQTFSFSQLNSVVHRLHDMSPSKKLPLVILHKSRVTGGPAQSPYNKKLLERWKNSGALYVTPAGSNDDWYWLYAAVCYKCLLVTNDEMRDHLFQLLGTSFFPRWKEKHQVRLSVSRSGIALQMPPPYSIVIQESENGSWHVPTTTNDDLETPRQWLCATRPIKS

SEQ ID NO: 189 - protein, 709 aa, Artificial Sequence
  mutant Populus trichocarpa 2
MATTLASNILHAKLSATDHDSPTKTINSRTRKENNALGFPSSRRIAKRVERKHVKNLTTSVVDEKTEKRFSKDRNTRKNMGFRESTGMGSENCTKDGKKGIRFLATMDSQGVCGEMESRTKNGSDIQVIKVDKIGKGSKQDKVDSSELKLRVRLDMCSKRGDVIAAIQLYDLAQREGIKMGQYHYAVLLYLCSSAAFSEDVKKYALQRGCEIFEKMCKEKVPINEATLTAVARMAMSIGNGDLAFEMVKQMDALGINPKLRSYGPALSVFCSSGDIDKAFYVEKHMLEHGVYPEEPELKALLRVSVEGGKGDKVYYLLHKLRRIVRRVSPSTAGIIVRWFNSKAASRVGKTKWDVKEAIENGGGGWHGQGWLGKGKWTVSCTSVGLDGICKYCGQKLTTIDLDAVETEKFAESVASIAIKRDRDSSFQRFQKWLDYYGPFEAVIDGANAGIYNQGRFMPSKINAVVNGIRQKLPSKKWPLIVLHNKRITGRKMDGPVNKAFIEKWKNADALYATPTGSNDDWYWLYAAIKFKCLIVTNDEMRDHTFHLLGNDFFPRWKERHQVHFRFTDAGPDFDMPPPCSVVIQESEKGHWHIPIETEGEGEGEAEREWLCITRANSRTTRHSITTTPGGSQSVGHGKKQARSSMQTRVAIKPDRLKHNIPDNIRKPPQDYKNLKDILAASGFPDHRTVLSEIETAEELGDTVIDFQI

SEQ ID NO: 190 - protein, 557 aa, Artificial Sequence
  mutant Populus trichocarpa 3a
MNQTPESQFNYNLNFYSKSKDLHSAISLYDTAISQDTRLNQHGFNTLLYLCSVSLNDPSTEELALRCGLRIFDHMVSNGIKPNEASITAVARLAAAKGDGDYAFDLVKNVGAYNELPRLRTYDPALFCFCEKLEAHKAYEVEEHMGSMGVGLEEGEIAALLKVSVESRNEKRVYGYLQKLRKMLRCVRGETAKVIEHWFAVFEGSGVELDVDLVREAVSRNGGGWHGLGWIGKGKWVLKRGSVDVGGKCCCCGEQLVSVDIDDDETERFAESVAGLAMQREVKANFSEFQNWLEEHANYEAIVDGANIGLYQQNFAEGGFSISQQLDAVVKDLYNQSGKKWPLIIMHNKRLRALLQNPSTRELIQEWIEKDVLYTTPQGSNDDWYWLYAAVKLRCLLVTNDEMRDHIFELLGSDFFIKWKERHQVRYTFVKGKLELQMPPLFSVVIQESENGSWHVPVAGNGNDSPQSWLCVSRPRACDALEEDSCMEGSKDSNDICCNSKLLSFGRPESLTSCKNKLQSQASFQESDNKITALTCKRKERSPSPSYLHVPCDQRHQ

SEQ ID NO: 191 - protein, 546 aa, Artificial Sequence
  mutant Populus trichocarpa 3b
MSNQTPESQFSYNLNFYSKSKDLHSAISLYDTAISQNTRLNQHNFNTLLYLCSISLNDPSTKDLSLQYGFRVFDHMVSNGIKPNEASITAVARLAAAKGDGDYAFDLVKNIGVYNELPRLRTYDPALFCYCEKLEGDKAYEVEEHMRRIGVGLEEGEIAALLKVSVETRREERVYGYLQKLRKMVRCVREETAKVIEHWFEVFEGNGVELDVGLVREAVSRNGGGWHGLGWIGKEKWVVRRGSVNAGGKCCCCGEQLVSVDIDDDETERFAESVAGLAMEREVKANFSEFQNWLEKHANYEAIMDGANIGLYQQNFAEGGFSFSQLDAVIKDLYNQSGKKQPLIILHNKRLRALLQNPSTRELIQEWIEKDVLYTTPHGSNDDWYWLYAAVKLRCWLVTNDEMRDHIFELLGSDFFVKWKERHQVRYTFVKGNLELQMPPLFSIVIQESENGSWHVPVAGDGNDSPQSWLCVSRPSSCDALKEASCMEESKDSNDSRCNSKLPTFGRPESLASCKHKLHSRDSFQESDDKITALTGKRKERSPSPS

SEQ ID NO: 192 - protein, 506 aa, Artificial Sequence
  mutant Eucalyptus_1
MSRKAKKKERMELPESLLKFKLDMCSRHGKLVEALQLYDEARENGVPLSHYHYNVMLYLCSSAGSGSLGQGGSENDENLKELGMRRGFEIFRQMAIDNVAPNEATFTNAARLATAREDPEMAFDLVKKMKNFGIPPRLRSYGPALFGFCKKGNADKAYEVDEHMVDCGVLAEESELSALLKVSMDAKKADKVYELLHRIRATVRQVSESSAQIVEDWFKSDFAASVGVESWDINKIKEGVVKGGGGWHGQGWLGSGNWRIRRTQMDKKGVCQSCGEKLVCIDIDPKETENFASSLTKLAREKEAKAGFTKFQAWIQKHGPFDAVVDGANAGLVNQKRFNFFQVNFIMNKLREMSPSKRFPLLILHKRRVHGKPDKDPRNQKLLETWENSGALYPTPLGSDDDWYWLYAAVHWNCLLVTNDEMRDHLFQLLGSSFFPRWKEKHQVRISVSKRGIQLHKPPPYSIVIQESENGNWHVPTVTGDDLETPRQWLCATRSKNVSNPLLNLF

SEQ ID NO: 193 - protein, 665 aa, Artificial Sequence
  mutant Eucalyptus_2
MYSKSGDFLGAVQWYDSARKEGIQLGQYHYAVLLYLCASAAVGVVQPAKSGSGARTLNRLDLLNEDVTTNRVKFGEEDEVVSNDLLSIGARGIEGNAGKMDLRSNRTNGNVEYTDEIKSIRQNFNGFPKPNAHVSDRLNDVGKTKGDSSDIENEAIDQEDQVVIFDENLKKFAVEKGFEIYREMCSDKVPMNEATLTSVARMAMSIGDGDMAFDMVKQMKPMGINPRLRSYGPALSTFCNSGDIEKAFEVENHMLKNGVYPEEPELQALLRLSIAVGRGDKVYYLLHKLRTSVRKVSPYTADLIEDWFKGKVASDIREAIKNHGGGWHGKGWLGRGKWSVSRASVGSDGSCKCCGEKLATIDLDPWETEKFAKSVAALALKREKNSSFQKFQKWLDYFGPFEAVIDGANAGLFSQQRFLPAKVNAVVNGIRQKLPLRRWPLIILHNRHITGKKMEVPVNRAIIDKWRNKDALYLTPTGSNDDWYWLYAAIKFKCLIVTNDEMRDHTFQLLGNDFFPKWKERHQVRFSFSDAGPEFHMPPPCSVVIQESENGHWHIPILLEHEYEADRTWLCVTRASSGLATRPEDLQLHQWSEQHVMEDKDPQDGVDPFSETLQPNHDNVRKSPPETHQNLKNIFAAAVSSYDSTLLSELDTAERCGNCIIDFQI

SEQ ID NO: 194 - protein, 505 aa, Artificial Sequence
  mutant Eucalyptus_3
MNAVAEASLKESALDHGFRIHAHMESCGVAPSEATVTAVARLAAARGDGDYAFGLVRKMGERGIAPRLRTYDPALYCFCGALEADKAYEVEEHMRSAGLSLEEPELSALLRVSAETGREERVYEYLHKLRDCVRWVSEETAVSIESWFSGEKAVGVGDVNYDRSHVKDVVLRNGGGFHGLGWIGKGNWVVRRGNVDENGVCSCCGERLACVDIDDMETESFASSIAALACERESKANFSDFQDWLEKHADYEAIVDGANIGLYQQNFADGGFSVPQLDAVVKELYGRSKGKWPLVILHNKRLKGLLESSPHKQLLQEWIDKGVLYTTPSGSNDDWYWLYAAVRLRCLLLTNDEMRDHIFELLGSKFFSKWKERHQVRYTFVKGSPVLIMPLPFSPVIQESETGSWHVPVKDDSNEEIVRTWVCITRPSVCKSSNGVLASKESPEGSNNFLNDHKLLNSSKPGTTTEDSNALGSIGFSQDCVNNTNIMTRKRKERSSSPPPLASSS

SEQ ID NO: 195 - protein, 520 aa, Artificial Sequence
  mutant Ricinus communis 1
MSSALSAKPQIHESSALAAKKVSNKAKKKARQESPEGVLRSKIDNCSKHGNLVEALRLYDEARINGVQLNQHHYNVLLYLCSSGSSVELGGNGANEKASNMQFKRGFEIFQQMVIDKVPPNEATFTNAARLAIAMEDPEMAFDLIKQMKCFDILPKLRSYGPALFGFCKKGMADRAYAVDAHMAESGVMPEEPELSALLKLSVDIKRADKVYEMLHRLRATVRQVTETTIDIIEAWFKSEDASKIGEEKWDVSKVREGVVRGGGGWHGQGWLGSGQWRVVRTQIDAKAVCNSCSEKLVCIDIDPSETENFATSLTNLACQREVKADFVRFQEWLQKHGPFDAVIDGANLGLINQTNFSFRQLNTVVSKLRQMSPSKRLPLIILHRSRVTGGPAQNPNNMKLLEFWKKSGALYATPTGSNDDWYWLYAAVSCNCLLVTNDEMRDHLFQLLGTSFFPRWKEKHQVRLSVSRSGIALHMPPPYSIVIQESENGSWHVPTISEDDLETPRQWLCASRTRNKVVL

SEQ ID NO: 196 - protein, 721 aa, Artificial Sequence
  mutant Ricinus communis 2
MSTRYKGATKERKYMDNQLISGRMEGDPQEVKFRLELDKCCKRGDVMAAIQLYDLAQREGIKMGQYHYTVLLYLCSSAAAGVVQPGKSGRGGRASNSLAVSDEVSSASVVEFRELRDKNDVDATESDTKILNNVNKVIDSGRNPGSKDKMELKSSNRFNDSDSTSNERKNLSQIPIVVSDSNYQQLECLSFPAKNNDGKYHDGNGILVSEDIKKYALERGFEIYEKMCMDKIPMNEATLTAVARIAMSMGNGDMAFDMVKQMKLLGLNPRLRSYGPALAAFCSSGDADKAFTVEKHMLDHGVHPEEPELEALLRVSVEAGKGDKVYYLLHKLRTSVRKVSPSTANIIIEWFKSKAASRVGKTKWDKRVVKEAIANGGGGWHGQGWLGKGKWTVSCSSVGVDAFCKSCGKKLATIDLDPTETESFAESVASIAIKREKDSSFQKFQKWLDYYGPFEAVVDGANVGLLGQKRFIPSKINAIANGIRQKLPSKKWPLIVLHNRRVTGHKMDEPVNKSLVEKWKHADALYATPTGSNDDWYWLYAAIKFKCLIVTNDEMRDHTFQLLGNDFFPKWKERHQVHFGFSDAGPVFHMPPSFSVVIQESENGHWHIPIASDTDYEPERAWLCITRAKLPLPRKDSITIKPEESQFVKRSSGQAKLPTKTRVKAKQGTLNHGSDEDNSPEQVYKNLRNILSASGFTDHRTVLSEIEAAEKLGDSVIDFQI

SEQ ID NO: 197 - protein, 543 aa, Artificial Sequence
  mutant Ricinus communis 3
MNQTPESQFNYNLNFYSKSKDLNSAISLYKTAISNKTQLNQHHYNTLLYLCSISLNDPSEKELALQNGFDIFEHMVATGIKRNEASITAIARLAAAKGDGDYAFNLIKNMLVDNQLPRLRTYDPVLFCFCEKLEAFKAYEVEDHIVSMGMNLEELEIAALLKVSVETKNKERVYGYLQKLRKTVRCVKEETAKIVEDWFKDFEVNGKELDVGLVRKAVVKNGGGWHGLGWIEKGKWGVKRGNMDMDGRCCCCGESLACVDIDDLETERFAGSLAGLAMEREVKANFSEFQDWLDKNADYDAIVDGANVGLYQQNFAEGGFSISQLDAVVKELYDRSGKWPLIVLHNKRVRAILENPSQRNLIQEWTEKDILYTTPHGSNDDWYWLYAAVKLKCLLVTNDEMRDHIFELLGSSFFLKWKERHQVRYTFVKGKLKLQMPPPFSVLIQESEKGSWHVPIAGDGNEDSAQSWLCITRSSACYAPDKDEMNIETFETEYQDRILLSPSKANSITGYNDILDSEESFPHSENKPATPTGKRKGRSTSPS

SEQ ID NO: 198 - protein, 529 aa, Artificial Sequence
  mutant Medicago sativa 1
MHTFNRATLPFTTTTINNTLSQTPTSQNNTESTTHPIKLSTKARRKAAQESPVGILQKKLNNCSKTSDVLQALNLYDEARKAHVPLNLDHYNKLLYLCTVQNGDGSFFHLGLQRGFEIFEQMLRDNVEPNEATFTNAARLAAAKEDPEMAFELLKQMKRVGIAPKLRSYGPALYGFCARGDAMKAYEVDDDMIESGVMAEEDELCALLEVSVEVKNEDKVYEILHRLRAVVRQVSESTLKVIEDWFESEYAMKIGKREWDDEEIREGFVRGGGGWHGQGWLGSGEWKVVKTNVDEDGMCLSCSEKLVSIDIDPKETENFAASLSKLAHEKQPKANFNHFQKWLEKNGPFDAVVDGANVGLANIAEFSFKQLDYVVRQLRQLSPSKRLPLIILHVNRVTGGPAQNPNNKRLIENWKKNGVLYATPHGSNDDWYWLYAAVSCKCLLLTNDEMRDHLFQLLGSSFFPRWKEKHQVRVSVSTRGASLVLPPRYSLVIQESANGSWHVPTVVSDEPDIPRKWLCVTRSRKKLIT

SEQ ID NO: 199 - protein, 463 aa, Artificial Sequence
  mutant Medicago sativa 2a
MHRDKRNGIMVSEVVKEYALQRGFEVYENMRMSKVEMNEAALTSVARMAMALSDGDKAFEMVKQMKILGINPRLRSYGPALSTYCNNGEIDKAFDVEKHMLEHGVYPEEPELEALLRVSIRGGKSDRVYYVLHKLRSSVRKVSTTTADLIVDWFKSKIALKVGKRKWDNGLIMKAMQNNGGGWHGTGWLGKGKWQVLQTSVRKDGMCKCCGVQLATIDLDPVETENFAKSVASIAISNEKNSNFQTFQKWLDYYGPFEAVIDAANINAVVNELRQKLPSKKFPLIVLHHRRIKGDKRDVPINKALVDRWNNANVLYATPTGSNDDWYWLYAAIKFKCLLVSNDEMRDHLFQLLGNDFFPKWKERHQVRFGFSDAGLEFYMPPPCSVVIQESEEGHWHIPIEAELNDEAERRWLCITRAKLDMVSGDSSTTSKDEKPLQNGEQAKSVTRKESAKELQYQNLVNH

SEQ ID NO: 200 - protein, 466 aa, Artificial Sequence
  mutant Medicago sativa 2b
MNDKDRDKRNGIMVSEVVKEYALQRGFEVYENMRMSKVEMNEAALTSVARMAMALSDGDKAFEMVKQMKILGINPRLRSYGPALSTYCNNGEIDKAFDVEKHMLEHGVYPEEPELEALLRVSIRGGKSDRVYYVLHKLRSSVRKVSTTTADLIVDWFKSKIALKVGKRKWDNGLIMKAMQNNGGGWHGTGWLGKGKWQVLQTSVRKDGMCKCCGVQLATIDLDPVETENFAKSVASIAISNEKNSNFQTFQKWLDYYGPFEAVIDAANINAVVNELRQKLPSKKFPLIVLHHRRIKGDKRDVPINKALVDRWNNANVLYATPTGSNDDWYWLYAAIKFKCLLVSNDEMRDHLFQLLGNDFFPKWKERHQVRFGFSDAGLEFYMPPPCSVVIQESEEGHWHIPIEAELNDEAERRWLCITRAKLDMVSGDSSTTSKDEKPLQNGEQAKSVTRKESAKELQYQNLVNH

SEQ ID NO: 201 - protein, 422 aa, Artificial Sequence
  mutant Lotus_1
MLYLCSIPHSDSMDSGQVGLERGFEIFQQMMREKVKPNEATFTNAARLAAAKEDPQMAFELLKQMKDVGIAPKLRSYGPALFGFCKRGEFEKACEVDADMIESGLVAEEPELSALLEVSVSAKKEDKVYEILHRLRATVRQVSESSLQIIEDWFNSEYAMKVGEENWDADKVRDGIVRGGGGWHGQGWLGSGQWKVVKTHVNEDGMCLSCGEKLVSIDLDPKETENFATSLSKLACQRETQSNFNNFQKWLKQHGPFDAVVDGANVGLANQHNFSFSQLNNVVKQLRQISPSKRLPLIILHVSRVTGGPAQNPNNKRLLEHWRENGALYATPQGSNDDWFWLYAAVSCKCLLLTNDEMRDHLFQLLGSNFFPRWKEKHIRVSASAGRVSLVMPPRYSIVIQESANGSWHVPTVTSDDDHEIP

SEQ ID NO: 202 - protein, 477 aa, Artificial Sequence
  mutant Lotus_2
MKLKIAFDMCSKRGDIMEALSLYDAARSEGLKLQQHHYTVLLYLCSSAAVGVVQPAKSGSGARTLNAQVELVNHEDNDNSVSVDRNERDFSNGILVSGDVKKYALKRGLEVYESMSQSKVKMNEASLTSVARMAMAIGDGDMAFEMVKQMKSLGINPRLRSYGPALSTFCNNGEIDKAFAVEKHMLEHGVCPEEPELEALLRVSNSIRAGKGDKVYYVLQKLRTSVRKVSPSTAQLIIDWFKSTQASLIMEAIENHGGGWHGQGWLGKGKWRVVHTAIGNDGICKCCGVHLATMIKWLDYYGPFEAVVDGANVALFGQGRFIPSKINAVVNGIRQKLPSKKFPLIILHNRRIKGDKGGEAINGALIDRWNNADALYATPTGSNDDWYWLYVAIKFKCLIITNDEMRDHLFQLLGNDFFPKWKERHQVHFSISDTGPEFYMPPPCSVVIQESEEGHWHIPIETELSNESERRWLCITR

SEQ ID NO: 203 - protein, 513 aa, Artificial Sequence
  mutant Aquilegia_1
MSSTPNVRTPSKRAQNKAQRQSPEGQLRYKLDMCSKDGDLVEALRIYDDARSNKFSLSKHHYNVLLYLCSSSDVLVQENVFNQKDEKSRNLGLRRGFEIFKQMGIDGIAPDEATFTNASRLAAKMEDPEMAFELLKKMMNSNIPPKLRSYEPALFGFCNKGEANKAYEVDAHMLASGVTPEEPQLVALLRVSVNVKNADKVYEIIHRLRASVRQVSDSTAKIIEEWFKSKEAMEVGKESWDVNKVKEGIVKGGGGWHGQGWLGKGEWKVVKTEMDENGVCHCCGERLVCIDIDPLETENFANLLSRLACQREAWANFNQFQNWLKNNGPFDAVIDGANVSLNNGHAFSFFQLNAVVERVREFSPTKRLPLIILHTGRVVGGPANSPKNKALIEQWRRFGALYTAPKGSNDDWYWLYAAVNCKSLLVTNDEMRDHLFQLLGTSFFPRWKEKHQVRYKVSRDGTVLQLPPPYSIVIQESERGGWHIPIASADDVDTPRQWVCASRASTSLNSAIS

SEQ ID NO: 204 - protein, 754 aa, Artificial Sequence
  mutant Aquilegia_2
MCSLEHQHSIKTLNPTTQKEYNYGFFPLKSRDERVGRKAKVSSIVGEKTGKKYRKDVDSRRKREMGSGVSSLGSVEERVEIKSKVADKVVDEKMTKFSKKSNGSSKLRNETSNKNSSGSNADFQVGEGKSRKRRKKEKVETPEFKLKAGLDMCSKRGDLLSAISLYDTAQKEGVKLGQYHYTVLLYLCSSAAVGVIRPAKSGSGSRTSDKLDLMNEVPNENVHVRLDPSTSSHGYPIDSSSESHVLSSNKVQEINNSELEPVKYVIPLGNKTERLANKLFDKTSNTSNGFYTGIDQEDSDREREGNSNQEDHKIQVSEDVKKYALVRGFEIYENLCLEKIPLNEATLTSVARMAMSMGNGDMALEMVNKMKEMGINPRLRSYGPALFTFCKTGDIDNAFMVEEHMLENGVYPEEPELEALLRLSVEAGRGDKVYYLLHKVRNSIRKVSPSTADLIERWFRSKPASTVGERNWDHRLIMEAMENGGGGWHGQGWLGKGRWNSARTFIGTDGVCESCGDKLVTIDLDPTETENFAKSVASIAAKRERKSCFQNFQKWLDYYGPFEAVVDAANVGLYSQRHFSTSKVNAIVNGIRQKLPSKKWPLIVLHNKRITGGRMDEPANKTLVEKWKNADALYATPTGSNDDWYWLYAAIKFKCLLVTNDEMRDHIFQLLGNDFFPRWKERHQVHFNFSDSGPEFIMPPPCSVVIQESEKGHWHIPIESEVASERERTWLCVTRSDPERPGSPKKHKGIYSEE

SEQ ID NO: 205 - protein, 531 aa, Artificial Sequence
  mutant Aquilegia_3
MNLEGQFMYDLGTCSKSNDLAGALSLYEKAISQNLRLNHNHLNTLLYLCSNSLHDLASKDSAIEKGFGIYERMIANNINPTEATITAVARLAAANGDGDFAFELVKSMGKYKIVPRLRTFDPALFAFCEKLEAEKAYEVEELMVSMGIHLEEPEFAVLLKVSSEVGREDKVYLYLHKVRNCTRCVSLVTGEIIESWFNKGLASEVGVSEWDENGIKDAMLKNGGGWHGQGWLGKGKWVVSKSNINLEGCCCSCGERLVCVDIDRAETEKFAESVASLATKREAKSDFRVFQEWLDNHSGYEAIVDGANVSLYQQNFADGGFSISQLEAVVKDLYDRSGKWPLVIMHNKRVSSLMDNPSNLKILEDWKNQGTLYTTPNGSNDDWYWLYAAVKLKCLLVTNDEMRDHIFELFGSNFFLKWKERHRVRFTFLKNNLRLLMPPSYSLVIQESEKGSWHVPIDGECNDELLRTWLCITRPRLHDYSSEVLKSSHSLVLDRPFSNHMSTMNGSHNNESKALSGKRKSRSPSPSKGHP

SEQ ID NO: 206 - protein, 524 aa, Artificial Sequence
  mutant Eutrema halophila 1
MGTRDRRLLLVEHKRHLCTMPVAAKQSQASPSENLSRKARKKAIQQSPETLLKQKLDMCSRNGDAVEALRLYDEAKRNGVQLSQYHYNVLLYVCSLSEAGTESSPNPGLSRGFDIFKQMIVEKVVPNEATFTNGARLAVAKDDPEMAFDMVKQMKAFGIQPKLRSYGPALFGFCRKGDADKAYEVDAHMLESEVVPEEPELTALLRVSMDIKNTDKVYETLQRLRDLVRQVSKPTFDTIEEWFNSEAAAKAGVEKWDLKKIKDGVVSGGGGWHGQGWLGTGKWNVTRTEMDENGVCKCCKDKLVCIDINPVETENFAASLTRLACEKEVKSNFNQFQEWLQRHGPFDAVIDGANMGLVNQRSFSFFQLNNVVQRFQQNSPSKRLPLVILHKSRVIGGPATYPKNRALLEKWKNAGALYATPPGSNDDWYWLYAAVSCKCLLVTNDEMRDHLFQLLGNSFFPRWKEKHQVRISVSREDGLTLHMPPPYSIIIQESEDGTWHVPMSVKDDLQTSRQWLCARRSKTH

SEQ ID NO: 207 - protein, 529 aa, Artificial Sequence
  mutant Eutrema halophila 3a
MNPETNLLFNLNSCSKSKDLSAALALYDAALVSNDVSLSQQHFQTLLYLCSASISDPSLQSLAIDRGYQIFDRMVSSGISPNEASVTSVARLAAAKGDGDYAFKIVKDFVSAGGTSIPRLRTYAPALLCFCEKLEAEKGYEVEEHMDAAGIELEEAEISALLKVSCATSREDKVYRYLHKLRESVGYVCEETLKVIEEWFCGEKAGEFGDNGIGSDAGMLREAILKNGGGWHGHGWIGEGKWIVKKGNVSSTGRCLSCSEQLACVDTNEVETQKFVDSLVSLAMERKSKMNSCETKGDFSEFQDWLEKHGGYEAIVDGANIGLYQQNFADGGFSLPQIEAVVKELYHKSGNNKWPLILLHKKRVKTLLENLTHRNLVEEWINNGVLYATPPGSNDDWYWLYAAAKLKCLLVTNDEMRDHIFELLGNSFFQKWKERHQVRYTFSKGNLKLEMPSSFSVVIQESEKGSWHIPVSCQNIEESSRTWICIRRKSVLDSPKFNEKLATSGNGKILSSCNNNSLLSSCDAGNDQN

SEQ ID NO: 208 - protein, 495 aa, Artificial Sequence
  mutant Eutrema halophila 3b
MPEKNLLINLHSCTKSKDLEAALALYDEAITSGDVRLGQQHFQSLLYLCSASISDPDLETLAIYRGFQIYDRMVSSGISPNESTVTAVARLAAAKGDGDFAFKLVLDIVAGGVSVPRLRTVAPALLCFCERLEARQAYEVEEYMDALGIVLEEVEISALLKVSIGTEQANKFYKYLHKLRENVGCVSEETSKIIEEWFREKASEVRGKVSDIELLRAAVLKNGGGWHGLGWVGEGKWIVKKGNVSPAGKCLSCGEHLACVDANEVETEKFVNSLVALAMERKAKMNSCEPTADFSEFQEWLEKHGDYEAILDGANIGLYQQNFADGGFSLPQLEAVVNELYKKSGNKKWPLILLHKKRVDALLGNPNHRELVEEWINNNVLYTTPPGSNDDWYWLYATAKLKCLLVTNDEMRDHIFELLSTSFFQKWKERHQVRYTYVKGCLKLEMPPPFSVVIQESEKGSWHVPITCQNIEESVRNWICIRRESLYIHSREKIQ

SEQ ID NO: 209 - protein, 475 aa, Artificial Sequence
  mutant Eutrema parvulum 1
MLKQKLDMCSRNGDVLEALRLYDEAKRNSLQLSQYHYNVLLYVCSLSDAETESSSPNPGLSRGFDIFKQMIVEKVVPNEATFTNGARLAVAKDDPEMAFDMVKQMKAFGIQPKLRSYGPALFGFCKKGDADKAYEVDLHMLESEVVPEEPELTALLKVSMDTENAEKVYESLQRLRDLVRQVSKSTFDAIEEWFKSEAAAKAGVEKWDVKKIRNGVVSGGGGWHGQGWLGTGKWNVTRTEMDENGVCKCCKEKLVCIDINPVETENFAASLTRLACQKEVKASFNQFQEWLKRHGPFDAVIDGANMGLVNQRSFSFFQLNNVVQRFQQISPSKRLPLVILHKSRVIGGPATYPKNRALLEKWKNAGALYATPPGSNDDWYWLYAAVSCKCLLVTNDEMRDHLFQLLGTSFFPRWKEKHQVRISVSRENGLTLHMPPPYSIIIQESEDGTWHVPMSVEDDLQTSRQWLCARRSKTL

SEQ ID NO: 210 - protein, 524 aa, Artificial Sequence
  mutant Eutrema parvulum 3a
MNLLFNLNSCSKSKNLSAALALYDAAVTSNEVQLSQQHFQTLVYLCSASISDPSLQTVAIDRGYQIFDHMVSSGISPNEASVTSVARLAAAKGDGDYAFKIVKDFASVGGISIPRLRTYAPALLCFCERLEADKGYEVEEHMDAAGITLEEAEISALLKVSAATGRENKVYRYLHKLREYVGCICEETSKIIEEWFCGEKAGEVSDKEIGADAGLLREAILKNGGGWHGHGWVGEGKWVVKKGNVSSAGRCLSCSQHLACVDTDEVETQKFVDSLVSLAMERKAKMNSCETKVDFSEFQDWLEKHGEYEAIIDGANIGLYQQNFADGGFSLPQLEAVVNELYHNSGDNKWPLILLHKKRVKTLLENPANKNLVEEWINKGVLYATPPGFNDDWYWLYAAAKLKCLLVTNDEMRDHIFELLGNSFFQKWKERHQVRYTFAKGNLKLEMPSPFSVVIQESEKGSWHVPVSCQNNEDSSRTWICISRQSTIHSPKVNGKVETSGNGKIISSCNNSLLSSCDAGINEN

SEQ ID NO: 211 - protein, 487 aa, Artificial Sequence
  mutant Eutrema parvulum 3b
MNLLVNLHSCSKSKDLSAALALYDAAITSGDVRLTQQHFQTLLYLCSASLSDPSLQTLAIDRGFQIFELMVSSGISPNEASVTAVARLAAAKGDGDYAFKVVKDIVAVGGVSVPRLRTYAPALLCFCEILEAEKGYDVEEHMDASGIALEEVEISALLKVSVATGRENKVYRYLHKLREFVGCVSEETSEIIEEWFCREKASKVSGSGIGSDIVLLRAAVLKNGGGWHGLGWVGEGKWIVKKGNVTPAGKCLSCGEHLACVDTNEVETENFVNSLVALAMERKAKMNSSEPMADFSEFQEWLEKHGDYEAILDGANIGLYQQNFADGGFSLPQLEAVVKELYNKSGNKKWPLILLHKKRVNALLENPNHKNLVEGWINNNVLYTTPPGSNDDWYWLYAAAKFKCLLVTNDEMRDHIFELLSTSFFQKWKERHQVRYTFVKGSLKLEMPPPFSVVIQESEKGSWHVPITCQNCEESLRNWICITRQSL

SEQ ID NO: 212 - protein, 513 aa, Artificial Sequence
  mutant Mimulus_1a
MASHYSTTSAEALVQSSTNSGTRMSKKKARREAPEMILRVKLDLCSKDGNLTEALCLYNEARANGVQLNVHHYNVLLYLCCPNRDLSKEDEGNLTMLDRGFEIFKQMGIDKVEPNEATFTNLSRLAAAKEDPRLAFDLVKQMTEHGIVPKLRSYGPALFGFCKKGMADEAYEVDFHMRDNGVLPEETELTALLRVSSEFKKEGKVYEMIHRLRTTVRQVSEETAATITDWFKSKIASEIGEEKWDMEKVRKGFLEGGGGWHGQGWLGKGDWRVVRTTMDESGVCRSCGEKLVCIDIDPKETEKFAELLATLASQKEARTNFAKFQEWLQRQGPFDAVVDGANLGLANKHTFSFSQIARVVNELRQISPSKKLPLIILHQGRVSGGPAQNPNNKRLLESWKKGGSLYATPQGSNDDWYWLYAAVSCKCLLVTNDEMRDHLFNLLGNNFFPRWKEKHQARLKPSGDGLLTLHMPPPYSHVIQESKQGNWHIPTVTGDDLETPRQWICATRTRLHE

SEQ ID NO: 213 - protein, 512 aa, Artificial Sequence
  mutant Mimulus_1b
MSTSSGGQSLLQNERYSVTRRIKKQALRDSPEIMLRVNLDQCSKNGDLDEALRLYHEAKLNNIQLNVYHYNVLLYLCSLRSDDDGEEGLNPETLEKGFEIFKEMIIDRVELNEATFTNVSRLAAAKEDPELAFNLIKKMKDQGIGPKLRSYGPALFGFCKKGMADEAYEVDSHMVDNQVSAEESELSALLKVSSDVKREEKVYEMMHRLRATTRQVSEETAAVVEDWFLSERAAEVGLENWDTGKIKKGVLKGGGGWHGQGWLGGGDWRVVGTTMDEAGVCQSCGEKLVCIDIDPKETENFAKSLSELASKKEATTGFFQFQEWLQRHGPFDAVVDGANVGLANQHTFSFSQIKGVVNRLRELSPSKKLPLVVLHQNRVNGGPAQYPNNKKLLESWKKAGALYATPVGSNDDWYWLYAAVSSKCLLVTNDEMRDHLFNLLGNSFFPRWKEKHQVRLKPSSDGIRLHMPPPYSIVIQESEQGSWHIPTVTEDDLETPRQWLCATRARNSMPTP

SEQ ID NO: 214 - protein, 667 aa, Artificial Sequence
  mutant Mimulus_2
MATSLSEDVAEANSGNDVNADFLSGLSSFAVADDVSNNSHVRNHNRAQKPIEKRVILKDRHAAKIGLNSKSRKQVVSSSSSSSSSSSSSIRFKATHSVNSNLIEHKNNNKVPDKQKEKRRSKKDKIDSPESTLRVGLDMCSKRGDVVGAIKLYELAKKEFIKLGQYHYAVLLYLCSSAATEVKRAALRKGFEIYNEMRLENIPMNEATFTSVARMATAFGDGDMAFDMVKQMKEYGINPRLRSYGPALSIFCSNGDIDNAFKVESHMLEHGVYPEEPELEALLKVSIDAGKSEKVYNVLHKLRTSVRQVSSSTAELIERWFTSKTASRVGKRKWDQNLIIEAMKNGGGGWHGKGWLGKGKWTVSRSPVDSDGLCKCCGKKLVTIDLDPVETENFAKSVASIAAEREKDSSFQKFQKWLDYYGPFEAVVDAANVGLYSQRSFKPSKVNAVVNGIRQMLHCRKWPLIVLHNRRINGGKMEEPFNKALIEKWRTADAIYATPTGSNDDWYWLYAAIKCGCLLVTNDEMRDHLFQLFGNDFFPKWKERHQVRFSFTETGPTFRMPPPCSVVIQETEEGQWHIPIVSESENEDERIWLCCSRSNSSSPSSSSHHQNQESEIPRTQKKKREARISVETVFGESGKRNHRKNNTLLAQLETAEQLGDCAIDFQI

SEQ ID NO: 215 - protein, 491 aa, Artificial Sequence
  mutant Mimulus_3
MSTLDQCSKTKDLTAAISLYESSPSPTLTLGNLNSFLYICSNSLSDPETRQPAIEFGFKLFHHHSDGDNFKPNEATLTALSRLAAARGDGDYAFELAKSVKKYGVAPKLRTFSPALICFCGGAAAAADKAYEVEEYVESVGLHLEEPELAALLKVSIESGKEKKVYEYLHKLRATLREVDESTVAIIESWFSGKNAADVSVVSLDSDRIREANTRNGGGWHGLGFLGNGEWALQRSKIASYGQCCACNEQLVCVDTDTEETEKFAQSVASLAMERELHSNFKEFQDWLEKHSEYETVVDGANIGLYQQNFAEGGFSVTQLDAVVKETHSKSKKWPLVVMHKKRVRSILEDASKRELIEEWLDQGVLYGTPYGSNDDWYWLYAAVKLKCLLVTNDEMRDHIFELIGSNFFSRWKERHQVRYTFTKGGGLKLIMPPSYSLVIQESEKGSWHVPIAGEISDESSRTWLCVTRSGSIDAEEVSGNLIRNGSNNTS

SEQ ID NO: 216 - protein, 440 aa, Artificial Sequence
  mutant Jatropha_1
MARFCSFAHSTTPQIHESSVSGTNKVSRKSNKKARQESPEWVLKWKLDSCSKSGDLVEALRLYDEARSNGIQLTQHHYNVLLYLCSSGSSVELKGDRVVANASDLSFKRGFEIYQQMVTDKVAPNEATFTNVARLAFASEDPEMAFDLVKKMKGFDILPKLRSYGPALFGFCKKGMADRAYEVDTHMAESEVIAEEPELSALLKVSADAKRVEKVYEMLHRLRYTVRQVSDSTIGIIEDWFKSEDASKLGKQNWDVNKVREGIVRGGGGWHGQGWLGSGEWKTVRTKIDEQGICCSCGQKLVCIDIDPRETENFATSLANLACRKEVKADFVLFQYWLYAAVSCKCLLVTNDEMRDHLFQLLGTSFFPRWKEKHQVRVSVSRSGPALHMPPPCSIVIQESENGSWHIPTVTDDLETRRQWLCATRERHNYSDNNLAVSVA

SEQ ID NO: 217 - protein, 525 aa, Artificial Sequence
  mutant Arabidopsis thaliana 1
MGTRDRRLILVERSRHLCTLPLAAAKQSAASPSENLSRKAKKKAIQQSPEALLKQKLDMCSKKGDVLEALRLYDEARRNGVQLSQYHYNVLLYVCSLAEAATESSPNPGLSRGFDIFKQMIVDKVVPNEATFTNGARLAVAKDDPEMAFDMVKQMKAFGIQPRLRSYGPALFGFCRKGDADKAYEVDAHMVESEVVPEEPELAALLKVSMDTKNADKVYKTLQRLRDLVRQVSKSTFDMIEEWFKSEVATKTGVKKWDVKKIRDAVVSGGGGWHGQGWLGTGKWNVKRTEMDENGVCKCCKEKLVCIDINPVETETFAASLTRLACEREVKANFNQFQEWLERHGPFDAVIDGANMGLVNQRSFSFFQLNNTVQRCQQISPSKRLPLVILHKSRVNGGPATYPKNRALLEKWKNAGALYATPPGSNDDWYWLYAAVSCKCLLVTNDEMRDHLFQLLGNSFFPRWKEKHQVRISVTREDGLKLNMPPPYSIVIQESEDGTWHVPMSVEDDLQTSRQWLCAKRSKTP

SEQ ID NO: 218 - protein, 505 aa, Artificial Sequence
  mutant Arabidopsis thaliana 2
MVSRNPETNLLFNLNSCSKSKDLSAALALYDAAITSSEVRLSQQHFQTLLYLCSASITDISLQYLAIDRGFEIFDRMVSSGISPNEASVTSVARLAAAKGNGDYAFKVVKEFVSVGGVSIPRLRTYAPALLCFCEKLEAEKGYEVEEHMEAAGIALEEAEISALLKVSAATGRENKVYRYLHKLREYVGCVSEETLKIIEEWFCGEKAGEVGDNGIGSDVGMLREAVLNNGGGWHGHGWVGEGKWTVKKGNVSSTGRCLSCSEQLACVDTNEVETQKFVDSLVALAMDRKTKMNSCETNVVFSEFQDWLEKHGDYEAIVDGANIGLYQQNFVDGSFSLSQLESVMKELYRESGNNKWPLILLHKRRVKTLLENPTHRNLVEEWISNGVLYATPPGSNDDWYWLYAAAKLKCLLVTNDEMRDHIFELLGSTFFQKWKERHQVRYTFVKGNLKLEMPSPFSVVIQESEKGSWHFPVSCENNEESSRTWMCISRQSILDSPKSNGKIP

SEQ ID NO: 219 - protein, 494 aa, Artificial Sequence
  mutant Arabidopsis thaliana 3
MGNRNPEKSLLINLHSCSKRKDLSAALALYDAAITSSDIRLNQQHFQSLLYLCSAFISDPSLQTVAIDRGFQIFDRMVSSGISPNESSVTAVARLAAAKGDGDYAFKLVKDLVAVGGVSVPRLRTYAPALLCFCDTLEAEKGYEVEDHMDASGIVLEEAEISALLKVSAATGRENKVYRYLQKLRECVGCVSEETSKAIEEWFYGVKASEVSDNGIGSDIELLRAAVLKNGGGWHGLGWVGEGKWIVKKGNVSSAGKCLSCDEHLACVDTNEVETEDFVNSLVTLAMERKAKMNSCEPMADFSEFQEWLEKHGDYEAILDGANIGLYQQNFADGGFSLPQLEAVVKELYNKSGSKKQPLILLHKKRVNALLENPNHRNLVEEWINNNVLYATPPGSNDDWYWLYAAAKLKCLLVTNDEMRDHIFELLSNSFFQKWKERHQVRFTFVKGCLKLEMPPPFSVVIQESEKGSWHVPITSQDKEESLRSWMCITRQSS

SEQ ID NO: 220 - protein, 525 aa, Artificial Sequence
  mutant Arabidopsis lyrata 1
MGTRDRRLILVERSRHLCTMPLAAAKQSAASPSENLSRKAKKKAIQQSPEALLKQKLDMCSKKGDVLEALRLYDEARRNGVQLSQYHYNVLLYVCSLAEAATESSPNPGLSRGFDIFKQMIVDKVVPNEATFTNGARLAVAKDDPEMAFDMVKQMKAFGIQPRLRSYGPALFGFCRKGDAGKAYEVDAHMVESEVVPEEPELAALLKVSMDTKNADKVYEMLQRLRDLVRQVSKSTFDTIEEWFKSEAAAKAGVKKWDVKKIRDAVESGGGGWHGQGWLGTGKWNVKRTEMDENGVCKCCKEKLVCIDINPVETETFAASLTRLACEREVKANFNQFQEWLERHGPFDAVIDGANMGLVNQRSFSFFQLNNTVQRCQQISPSKRLPLVILHKSRVNGGPATYPKNRALLEKWKNAGALYATPPGSNDDWYWLYAAVTYKCLLVTNDEMRDHLFQLLGNSFFPRWKEKHQVRISVSREDGLTLHMPPPYSIVIQESEDGTWHVPMSVEDDLQTSRQWLCAKRSKTP

SEQ ID NO: 221 - protein, 507 aa, Artificial Sequence
  mutant Arabidopsis lyrata 3a
MISRSPETNLLFNLNSCSKSKDLSAALALYDAAVTSSELRLSQQHFQTLVYLCSASISDTSLRSLAIDRGFEIFDRMVSSGISPNEASVTSVARLAAAKGDGDYAFKVVKDFVSVGGVSIPRLRTYAPALLCFCERLDADMGYEVEEHMEAAGIALEEAEILALLKVSAATGRENKVYRYLHKLREYVGCVCEETSKIIEEWFCGEKAGEVSDNGIGSDVGMLREAVLKNGGGWHGHGWVGEGKWTVKKGNVSSTGRCLSCREQLACVDTNEVETQKFVDSLVALAMERKAKMNSCETQVDFSEFQDWLEKHGNYEAIVDGANIGLYQQNFVDGSFSLPQLESVVKELYRESGNNKWPLILLHKRRVRALLENPTHRNLVEEWISNGVLYPTPPGSNDDWYWLYAAAKLKCLLVTNDEMRDHIFELLGSSFFHKWKERHQVRYTFVKGNLKLEMPSPFSVVIQESEKGSWHFPVSCENNEESSRTWMCISRQSVLDSPKSNGKLATS

SEQ ID NO: 222 - protein, 494 aa, Artificial Sequence
  mutant Arabidopsis lyrata 3b
MGSRNPEKSLLINLHSCSKRKDLSAALALYDAAITSSDIRLNQQHFQSLLYLCSAFISDPSLQTLAIDRGFQIFDRMVSSGISPNESSVTAVARLAAAKGDGDYAFKLVKDIVVVGGVSVPRLRTYAPALLCFCESLEAEKGYEVEEHMDASGIMLEEAEISALLKVSAATGRENKVYRYLHKLRECIGCVSEETSKTIEEWFYGVKASEISDKTIGCDIELLRAAVSKNGGGWHGLGWVGEGKWIVKKGNVSPAGKCLSCGEHLACVDTNEVETENFVNSLVALAMERKAKMNSCEPMADFSEFQEWLEKHGDYEAILDGANIGLYQQNFADGGFSLPQLEAVVKELYNKSGNKKQPLVLLHKKRVNALLGNPNHRNLVEEWIDNNVLYATPPGSNDDWYWLYAAAKLKCLLVTNDEMRDHIFELLSNSFFEKWKERHQVRFTFVKGCLKLEMPPPFSVVIQESEKGSWHIPIKSQDNEESSRSWMCITRQSL

SEQ ID NO: 223 - protein, 541 aa, Artificial Sequence
  mutant Brachypodium_1
MLRRSSVPLARRRRHSYSSTSTALDDAPNNSPSPTLPGPGPPPAAGGGEGKASRRRRSRDSPEGLLKHKLDMCSRDGDLPTALALYDAALDPASSPPVPLSIHHYNCLLYLCSNAAATASDPDAASRGFEIFARMEAQGVEPNEATLTSVARLAAARRDPAMAFSVVRRMADAGIPPRLRTYGPALFAYCDAGDADGASEVEAHMDAGGVLPEETELAALLRVNADKGRADEVYRVLHRTRVLARQVCETTAQVIEAWFRSDAASQAGVDKWDAKKVKEGVVKGGGGWHGQGWLGKGQWDVERSEMDKNGKCQRCGEKLVCIDIDPSETENFAKSLTELACKREVRDDFLRFQGWLRRHGPFDAVIDAANIGLYNSKAFSFSQVNSVVNGIQRVTKSKKLPLIILHRSRVHCGPAIVPHNQKLIEGWRSAGALYSTPPGSNDDWYWLYAAVSCRSLLVTNDEMRDHLFQLLGTSFFPRWKEKHQVRLTYSGRGPTFHLPPPYSIVTQESEAGRWHVPTTTGDDIENPRQWICAIRKSQRRD

SEQ ID NO: 224 - protein, 689 aa, Artificial Sequence
  mutant Brachypodium_2
MLDVLPLRDRNPGGVANGGTPRTEEGAAGSPVVSCTAAQGDVTREVEASVSSGHGRNRTRRWRRGDSRLVLGEGTDRDVKERGWRGGPARTGESEGRRRDRRWTRGGMRVQESGKDGNLGNLSPRGEDRGGNLKRGKRLKSSEQGVMLRVALDLCSKRGDVIGAINLYDSAVKEGIRMGQHHYNVLLYLCSSAALGIVQPAKSGSAGKLDPASVESSGHPEDSNVPEGHVQNQEGNETILFPSVQIGSSIPVSDEIREYARTRGFEIFEKMCSEKERVAMSKAALTGVARMATSMGNGDMAFEIVKQMKELGITPKLRSYGPALTAFCDSGNVEKAFEVEAHMLESGVTPEEPELEMLLRASVVARRGDRVYYLLHKFRNTVRQVSPSTAEQIEAWFRSSTASKVGKRKWDACALAKEIENHGGGWHGLGWLGRGKWTITRSHIDKNGVCLACGGKLAIIDLDPKETEDFATLVATLALKRERTSNFDNFQKWLDDHGPFEAVMDAANVGLFSHRHLSVSKVNAVADAIQKRFPSRKWPLIVVHNRHLTGKHMKNPANHKWVENWKRADIIYETPTGSNDDWYWLYAAIRWKCLIITNDEMRDHTFQLLEKDFFPKWKERHQVRFSFGDSCVTFQMPPPCSVVIQESEKGHWHIPLSEESLLEEERTWLCVMRRSSQALYNEAGVNSDL

SEQ ID NO: 225 - protein, 484 aa, Artificial Sequence
  mutant Brachypodium_3
MGPNSDLSRTLTDCTRRGDAAAAMAAFDAAIVSGGPEDLRFAAHQYNQLLHLLASADRSSFPGGHPAVAASARRVFAHMLEATTAAPAEATITSLARVIASDPGGGDEAFELVATMRERYGLAPRLRSYGPVLAAFRRTGEAGKAYAVEAHMAASAVSPEEPELAALLDVSAKAGDADKVYEYMHKLRRAVACVSLETAEVLEGWFQSEKAAMAGKAEWDAQQVKDAIVANGGGCHQLGWLQNGPWVVRRATVGTDGECGGCGCCLASVDIDMEETQTFADSVSGLALERETKANFSHFQEWLEAHQEYEAIVDGANIALYQQNFADGGFSLVQLDAVVTELRDRYSGKWPLVILHNKRIAKLMENPSDRHLIETWRANGALYTSPSGSNDDWYWLYAAIGLNCLLVTNDEMRDHIFELLGSSFFHKWKQRHRVKYTFNKGKAVLLMPPPYSSEIQESETGSWHVPIEEKSGDERVRTWLCIGR

SEQ ID NO: 226 - protein, 529 aa, Artificial Sequence
  mutant Physcomitrella patens 1
MDPAESELRRSIDMCSKHADAMGAIEIYDKVVAEGKMSFNQYSYNVLLYLCSSGATVVLTDEQKQLCLQRGFAVYEAMKLQGVPPNEATFTAVARLAVAKDDGDLAFDMVKQMAKAKLSPRLRSYSPALHTYCKLKNIEKAFEVDEHMLAAGVQPEESELEALLKLTADAGLEDKVYPLLHRIRTTVRGLSPSTAGVVQQWFESSAGANAGKSNWNSLPSQETVKAAYESRGGGWHGLGWLGRGSWEVKPSELDANGVCQECGEQLVTIDIDPKETVMFAKSLSELACQREGKSNEFKKFQGWLDRHGPFDVIVDGANVGLFNQNFGEGGFNFHQLNSVVKGIKEKVGSKREPLILLHHRRTRGGPASSSFAIKILNKWQETHAIYTTPTGSNDDWYWLFAAVKYKCILVTNDEMRDHLFQLLGNDFFPRWKERHQVRFSLSREGPVFHMPPPYSMLIQESVSGSWHIPKSGGEDVSAPVKWLCVTRTGQPNPEILKVEEKLNHLLAGAGETGPDSKPVEEANSELKQT

SEQ ID NO: 227 - protein, 478 aa, Artificial Sequence
  mutant Physcomitrella patens 2
MKHADVKQALEIYDKTCKEGKIAFNQYNYNIILYLCSSAATDSLKPQKKQRILYMKRGFEVYEAMKSQGVPPNEATFTAVARLAVAKEDGDLAFDMVKQMAEANLSPRLRSYAPALYTYCKLKNHKKAFEVDDHMKKSGVALEESELEALLKVSVGAGLEDKVYSLLHRLRTTVRDVSPSAVEVIQQWFTSSAAATAGKSNWEHLPGPEYVKKATESCGGGWHGLGWLGRGTWEVKSSVVDDHGVCQECGEPLATIDLDPQETEMFAQSLSRMACQREAKNNEFKKFQGWLDRHGPFDAIVDGANVGLYNSNTPNGGFNFYQLNSVVTGIQKRLGLKREPLILLHHRRTKGGPADSSFAARMLSNWKENNSIYTTPTGSNDDWYWLYAAVRFRCVLVTNDEMRDHLFSLLGNDFFPKWKERHQVVRYTINREGLVFHMPPPFSTVIQESHKGSWHVPKSGKNDEDVLVPREWLCVTRT

SEQ ID NO: 228 - protein, 503 aa, Artificial Sequence
  mutant Physcomitrella patens 3
MDSAESELRRSIDMCSKFADVMGAIEIYDKVVAEGKVAFNQYTYNVLLYLCSSAATEVVVTDEERRLCLERGFVIYEAMKLQEVPPNEATFTAVARLAVAKEDGDLAFDMVKQMANAKLSPRLRSYSPALHIYCKLKNFEKAFEVEEHMLAAGVQAEESELEALLQLATDFGLEYKVYSLLHRIRTTVRGLSPSCAGVVQQWFESSPAASAGKSNWDSLPSPKTVKAAYESRGGGWHGLGWLGRGNWEVKSSVLDTGGVCQECGQQLVTIDIDPNETEMFAKSLSELACQREGKNNEFKKFQAWLNRHGPFDAIVDGANVGLFNQNFVDGGFNFHQLNSVVKGIKEKIGSKRNPLILLHHRRTRGGPANSPHAIKMLKRWQEAHAIFTTPTGSNDDWYWLYAAVQYKCVLVTNDEMRDHLFHLLGNDFFPKWKERHQVRFSMSKEGPVYHMPPPYSILIQESVSGSWHIPKSGNDVSQPGEWLCVTRPGHAKADDMKEEKLKE

SEQ ID NO: 229 - protein, 494 aa, Artificial Sequence
  mutant Selaginella moellendorffii 1
MVEEQERRASSPSPRKKKFNLVSEVRFTLDTCSKFGDVNGALSAYSSNREAVKFDLYNYNVLLYLCSSAALGEMMDGFLRKGLEIFEQMQAENVAPNEATFTALARLSVAKRDGDLAFEIVKAMIAAKIPPKLRCYGPALYVYFKRNDPEKAFEVYNHMLVHGVQPEEAELEVLLHLSSKACLGDRVYLLLHHLRETVRDVSQSTVSVIERWFKSDFAGRVTGNSLPGDFDVRCSSLAKGGGWHGLGWLGQGRWNVGYTSLTAEGVCCRCNEQMVTIDITPEDTDVFAKCIASLAFKRESNNSFGIFKDWLDRNGPFETVVDGANVGFYNQRFNGELNFAQLETVVADVQRRSGKWPLIVLHVGRTMKGSGRSSYAQQLLRHWSNAKALYIAPAGSNDDWYWLYAAVKCKSLLVSNDEMRDHIFQLLGREFFPTWKERHQVRFHVTKHGPVFHMPPPYSIIIQETERGSWHIPVSGGDDISSPRKWLCVTRGST

SEQ ID NO: 230 - protein, 488 aa, Artificial Sequence
  mutant Selaginella moellendorffii 2
MFTPDSELRFKLESCSKVGDVTGALDIYDSSKDQGVKLSQYHYNVLLYLCSSAALGVILALDRGLEIYERMKLEGISANEAAFTSIARLAVAKRDGDLAFSLVKEMTTSGITPKLRSYGPALYTYFKSNRVDKAFEVDDHMRSFGVQPEEMELQILLELSLKAGQEQRVYSVLHRLRRSVREVSPSTATTIERWFSSDAASSSGSDKKYDDEDVRRALAAQGGGGLELGWIGSGRWSVKRTALDASGVCESCRHKMAAVDLNAEETNRFAENLAALACEKERDANSFKEFQEWMAEHGPFDAIVDGANVALFNQNFSAGGFSFSQLNSVVTELSNQHGKSPLVILHKRRVTGGPAASPQSQELLKQWTAANALYTAATGSNDDWYWLYAAVTCKCLLVSNDEMRDHLFQMLGNDLFPRWKERHQVKLRALSYNPFFDMPPPYSTVIQECENGSWHFPISRGNDEDDEAEEPHKQPRSWLCIRRDEETK

SEQ ID NO: 231 - DNA, 1000 bp, Arabidopsis thaliana
ttcatagtcatggcattagcttctgttatcggagtcggtttggatcttgtgttggcttataggactaaggagatttacgctaagattcacgctagcaagaagtcaaagaaatctggtggtagccttagttaagacactgtatatctagttccggtgcactacattgttttcagatgctgattttgtatacatgatacaatatcggattcaagatattgttgaacaaaatttcaagtaccagagatcattgttgtagtagcatcgccaatgtatttttttgtctttccgagatttgttcaaaattatataaatgtatgacattttgatagtccaattccaattattttctaagattttatttagttacatatatatatactaagtggttaataatacacaatataatgcagaaaatcaccaatcttgtcacttttcagtcacttgtgaattaatgggcaattaatagatgggaactcgaatatgaccataataagaatttttgtggaaaattaagtgggatcaacaatgggatcactcgagaaccagctcacttacaagtgaatcgaaaactgaaccaagattacgctaaaccgggatcgacaattgaaaacccggttcaccttttaaatctattctgctcagtgagtagccgccgccgtggtctttgtcgaattcgtggtctctcctccacgcatcgacgttacgccaccatctaatctctttaaacctccgtcagctggtttatctcgccggcctcgtttacttcaaacaaggtaaggtctttcatctttgttaaggttttaggaactgaaactgttattggttttgaattggaatgaatactcaggagaactagaatagttagccaatccatagcaactctataatttgtatgtttctgttcacttttcaagaaaaagttcataatttttttgattcagggtttagggtttcatctaccactttctaccaatgcaaagcttgtaactttgaggtatac

SEQ ID NO: 232 - protein, 116 aa, Arabidopsis thaliana
TAGCTGCACCAGCTTATTGAGTTCATGTATCATTTGTTATGAGTTTTCATTCTTTGTCCTTTGAAGATTAACACAAAAAACGTTCATTGGTTCTATAATAAGGGACTGAACTTTTC

SEQ ID NO: 233 - DNA, 1518 bp, Artificial Sequence
  AtCytoRP2 cDNA
atggtaagcagaaacccagaaacaaatctcctcttcaatctcaattcatgctccaagtccaaggacctctcagctgcattagcactttatgatgcagccatcacttccagtgaagtacgtctcagccagcaacattttcaaacgcttctgtacctatgctcagcttccattactgacatatctcttcaataccttgccattgaccgtggtttcgagatttttgatcgtatggttagttcggggataagtcctaatgaggcatctgttacttcagtggctagactggctgctgctaaaggtaatggtgattatgctttcaaggttgttaaggagtttgtttctgttggaggtgtgtcgattcctcgtctgaggacatatgcgccggctttgctctgtttctgcgagaagttggaggctgaaaagggttatgaggtagaagagcacatggaagctgcaggtattgcattggaggaggcagagatatcggctttgttgaaggtaagtgctgccacgggtcgagaaaacaaggtttatagatatttacataagttgagggaatatgttggctgcgttagtgaagaaactttgaaaattattgaggaatggttctgtggagaaaaagctggtgaggttggtgataatggaattggttctgatgttgggatgcttagagaagctgttttgaataatggaggtgggtggcacgggcatgggtgggttggggagggtaaatggactgtaaagaaaggtaatgttagctcaacaggaagatgtttgagctgcagtgagcagttagcttgtgtagataccaatgaggtagaaacacagaagtttgtggattctttggtggctttggctatggataggaagacaaagatgaattcatgtgagacaaatgtggtcttcagcgagtttcaggactggcttgagaaacatggagattacgaagctatagtagatggagcaaatattgggctctaccaacaaaattttgtagatggcagtttcagtctttcacagcttgaatctgtgatgaaggaactttaccgtgaaagtggtaataacaaatggcccctaattctattgcacaagagacgggtcaagacgcttttagaaaacccaactcaccggaatctggttgaagaatggattagtaacggtgtcctgtatgcaactccaccaggttccaatgatgattggtattggctgtatgctgctgctaagctcaagtgtttgcttgtgacaaatgatgagatgagagaccacatttttgaactcttagggagtacttttttccaaaagtggaaagaaagacatcaggtccggtatacttttgtgaaaggtaacctgaagcttgaaatgccgtctcctttttcggttgtcattcaggaatcagagaaagggtcatggcatttcccggtctcatgcgaaaacaatgaagagtcttcaagaacttggatgtgtattagcagacaaagtattttagattcacctaagagtaatgggaagattccttag

SEQ ID NO: 234 - DNA, 2636 bp, Artificial Sequence
  CytoRP sequence cloned in pGWB13 vector
ttcatagtcatggcattagcttctgttatcggagtcggtttggatcttgtgttggcttataggactaaggagatttacgctaagattcacgctagcaagaagtcaaagaaatctggtggtagccttagttaagacactgtatatctagttccggtgcactacattgttttcagatgctgattttgtatacatgatacaatatcggattcaagatattgttgaacaaaatttcaagtaccagagatcattgttgtagtagcatcgccaatgtatttttttgtctttccgagatttgttcaaaattatataaatgtatgacattttgatagtccaattccaattattttctaagattttatttagttacatatatatatactaagtggttaataatacacaatataatgcagaaaatcaccaatcttgtcacttttcagtcacttgtgaattaatgggcaattaatagatgggaactcgaatatgaccataataagaatttttgtggaaaattaagtgggatcaacaatgggatcactcgagaaccagctcacttacaagtgaatcgaaaactgaaccaagattacgctaaaccgggatcgacaattgaaaacccggttcaccttttaaatctattctgctcagtgagtagccgccgccgtggtctttgtcgaattcgtggtctctcctccacgcatcgacgttacgccaccatctaatctctttaaacctccgtcagctggtttatctcgccggcctcgtttacttcaaacaaggtaaggtctttcatctttgttaaggttttaggaactgaaactgttattggttttgaattggaatgaatactcaggagaactagaatagttagccaatccatagcaactctataatttgtatgtttctgttcacttttcaagaaaaagttcataatttttttgattcagggtttagggtttcatctaccactttctaccaatgcaaagcttgtaactttgaggtatacatggtaagcagaaacccagaaacaaatctcctcttcaatctcaattcatgctccaagtccaaggacctctcagctgcattagcactttatgatgcagccatcacttccagtgaagtacgtctcagccagcaacattttcaaacgcttctgtacctatgctcagcttccattactgacatatctcttcaataccttgccattgaccgtggtttcgagatttttgatcgtatggttagttcggggataagtcctaatgaggcatctgttacttcagtggctagactggctgctgctaaaggtaatggtgattatgctttcaaggttgttaaggagtttgtttctgttggaggtgtgtcgattcctcgtctgaggacatatgcgccggctttgctctgtttctgcgagaagttggaggctgaaaagggttatgaggtagaagagcacatggaagctgcaggtattgcattggaggaggcagagatatcggctttgttgaaggtaagtgctgccacgggtcgagaaaacaaggtttatagatatttacataagttgagggaatatgttggctgcgttagtgaagaaactttgaaaattattgaggaatggttctgtggagaaaaagctggtgaggttggtgataatggaattggttctgatgttgggatgcttagagaagctgttttgaataatggaggtgggtggcacgggcatgggtgggttggggagggtaaatggactgtaaagaaaggtaatgttagctcaacaggaagatgtttgagctgcagtgagcagttagcttgtgtagataccaatgaggtagaaacacagaagtttgtggattctttggtggctttggctatggataggaagacaaagatgaattcatgtgagacaaatgtggtcttcagcgagtttcaggactggcttgagaaacatggagattacgaagctatagtagatggagcaaatattgggctctaccaacaaaattttgtagatggcagtttcagtctttcacagcttgaatctgtgatgaaggaactttaccgtgaaagtggtaataacaaatggcccctaattctattgcacaagagacgggtcaagacgcttttagaaaacccaactcaccggaatctggttgaagaatggattagtaacggtgtcctgtatgcaactccaccaggttccaatgatgattggtattggctgtatgctgctgctaagctcaagtgtttgcttgtgacaaatgatgagatgagagaccacatttttgaactcttagggagtacttttttccaaaagtggaaagaaagacatcaggtccggtatacttttgtgaaaggtaacctgaagcttgaaatgccgtctcctttttcggttgtcattcaggaatcagagaaagggtcatggcatttcccggtctcatgcgaaaacaatgaagagtcttcaagaacttggatgtgtattagcagacaaagtattttagattcacctaagagtaatgggaagattccttagtagctgcaccagcttattgagttcatgtatcatttgttatgagttttcattctttgtcctttgaagattaacacaaaaaacgttcattggttctataataagggactgaacttttctc

SEQ ID NO: 235 - DNA, 22 bp, Artificial Sequence
  P2-5'UTR-F
ttcatagtcatggcattagctt

SEQ ID NO: 236 - DNA, 21 bp, Artificial Sequence
  P2-R
tgaaaatgttgctggctgaga

SEQ ID NO: 237 - DNA, 111 bp, Turnip yellow mosaic virus
cctaagttctcgatctttaaaatcgttagctcgccagttagcgaggtctgtccccacacgacagataatcgggtgcaactcccgcccctcttccgagggtcatcggaacca

SEQ ID NO: 238 - DNA, 130 bp, Tobacco mosaic virus
tttccctccacttaaatcgaagggttgtgtcttggatcgcgcgggtcaaatgtatatggttcatatacatccgcaggcacgtaataaagcgaggggttcgaatccccccgttacccccggtaggggccca

SEQ ID NO: 239 - DNA, 157 bp, Brome mosaic virus
gcagacctcttacaagagtgtctaggtgcctttgagagttactctttgctctcttcgcaagaacccttaggggttcgtgcatgggcttgcatagcaagtcttagaatgcgggtaccgtacagtgttgaaaaacactgtaaatctctaaaagagacca

SEQ ID NO: 240 - DNA, 1466 bp, Nicotiana tabacum
ccatggcgcctgaaagtgtgctgcgccataagctagaccagtgttcaaaacacggtgacttacaggaagcccttcgcctttatgaagaagctaagttaaacaacatttcactcagtgttcatcattataatgtgttgctttatctttgttctgcttcttgtaccaaggaatttggtattgaaaaaggatttgagattttcaaacagatgggtgtaaatggtgttactcctaatgaggccacgttcactagtgctgctagattggcggttgctaagcaagacccagaaatggcttttgatatagtgaagaaaatgaagagttctggtgttcctccgaagttaagatcttatgggccagcattgtttgggttttgtgataagggaatggctgataaggcttatgaagttgacgtacatatgggggaatcaggggttgtggctgaggaagcagagctttctgcactgttaaaagttagttctttgtccgaaagggctgataaagtatatgagacgatgcatagattaagggcaaatgtaaggcaggtgtgtgaagagactgctggtgtgatagaggattggtttaactctgaatgtgctgcagagattggggtggagaattgggatgttgggaaagtgaaggaaggtgttgtgaaaggagggggtggttcgcatggacaaggctggttgggaaagggaaattggtccgtggtgagagccgagatggatagctctggagtttgtagttcgtgtggtgaaaagcttgtgtgcattgacattgatcccaaggagacagagaactttgctaattccttggcaaaattggcttgtgaaagagaagttaaggctaattttgtgcaatttcaggagtggcttcagaagcacggtccattcgatgctgtggtggatggtgcaaatgttggccttattactcaacgaagttttaatttctctcagctcagaaatgttgtcaataaattaagacagatgagtaaatcaaacaaacttccgctagttattttgcacaaaagtcgtgcaactggtggtcctgctcaacatcctaataacaagaagttgttagaaagctggaaaaaagcgggtgcactttatgccactccacatggttcaaatgatgattggtactggttatacgctgctgtcagttctaaaggtttgcttttgacaaatgatgagatgagagaccacttgttccaactgttgggcactagctttttccccagatggaaggaaaaacatcagatccggatgacagcttcaagagatgacggacttgagctccatatgccaccaccttattcaattgttattcaggagtccgagcatggttgttggcatgtgccaactgttattggagatgacattgagatgccaagacagtgggtatgtgcaaccaggagaaaagcactgcactctctctttcaaccaactggggaatcaaatcatctcgag

SEQ ID NO: 241 - DNA, 26 bp, Artificial Sequence
  Primer
taaccatggcgcctgaaagtgtgctg

SEQ ID NO: 242 - DNA, 29 bp, Artificial Sequence
  Primer
taactcgagatgatttgattccccagttg

SEQ ID NO: 243 - DNA, 240 bp, Artificial Sequence
  NtPRORP1 (genome T) gene fragment
  CDS (1)..(240)
  misc_feature (1)..(201): deleted part of NtPRORP1 (genome T) gene
atggtctttcgtcgcatgggtcatttttcaccttgtctttctaaaacctcacccttcttctctcttctcacgaaaaccccttatccatttcatcttccccatactatccacttcttcaaaccaattcataccaaattcccacatacatatcccttttccatgaaccaaaagacccatctcgccaagaaagcccggcgtgacgcgcctgaaagtgtgctgcgccataagctagaccagtgt

SEQ ID NO: 244 - protein, 80 aa, Artificial Sequence
  Synthetic Construct
MVFRRMGHFSPCLSKTSPFFSLLTKTPYPFHLPHTIHFFKPIHTKFPHTYPFSMNQKTHLAKKARRDAPESVLRHKLDQC

SEQ ID NO: 245 - DNA, 1583 bp, Cucumis sativus
ccatgggccaatcccctgaagtcaagttccagttagacctcactgactgttcgaggaggaaagatttactttcggccataactctctgcgaaactgcagtttcggagaagttgaaattcaatcagcagcactttaatactctcctctacctgtgttctaccgctatttctgacccgtccttgaaagaatctgccgtaagttttgggtttcgtgtatataatctcttgcaatccattggtgttattcccaatgaagctacagtcactgctgttgcaaggctcgccgcagcaaaaagggacggcgattctgcatttgaattggtgaaaacaattgggaaatataaagttacgcccaggttgcgcacttatgatcctgcattgatttgtttctgtgagaatttggaggtggataaggcttatgaggtggaacaacacatgaattctgctggggtggagttagaggaacctcaaatttctgcccttttgaagctgagttcagacacaggaaaagaggataaagtgtacgagtatttgcacaaattaagacgttttgtgaagtgtgttagtgagtctactgcaaagataattgaaggttggttttgtagtgaaaaggcctctgatattggtgaatcgactatggatatcggtctgattagggaagcaattttaagtaatggagggggttggcatggaaaggggtggattggtaagggaaattgggtggtgaaaagaacaaatgtttattccagtggcaaatgctgttgttgtgctcaacaattggttggtgtcgatattagttgtgctgagactgaaaattttgctcagtctttggctgctctcgccattgaaagagaggctcaaccgaattttataagctttcaggaatggttagaagtacataatcattgtgatgctattgttgatggagcaaatgttggcctctaccaacagaattttgcagattctggatttaatctttctcaggttgaggccgttgtcaaagaattatgtaagatgagcggggggaaatggccattagttctctggcacaataaacgcaccagggcttcattggataattcttcacatagaaaagttgtcgaggaatggatagacaaaggtgttctttattctacgcccattggctcaaacgacgattggtattggctttatgccgctgtaaaattgaagtgcttacttgtcacaaatgatgagatgcgagatcatatttttgaacttttgggaaacgacttatttctcaggtggaaggagaaacatcaaattcgttacacttttgttaagggtcaactgagacttgaaatgcctcccccttattctgttgtaattcaggagtcagaaacgggatcttggcatgttccaattgcagccaacgactccgaactggaacgaacttggttgtgtgttaccaggccaggtgtttctgcagcctcggatgtggcggtgaatggtgaaacttgtgaaagtattgaggctcaagggtcatgtgcatcaatgagcgttaaactgctggattcgtcggtagcacgtaaaagaaaagaaaggccctcatccacttccctcgag

SEQ ID NO: 246 - DNA, 29 bp, Artificial Sequence
  Primer
taaccatgggccaatcccctgaagtcaag

SEQ ID NO: 247 - DNA, 27 bp, Artificial Sequence
  Primer
taactcgagggaagtggatgagggcct

SEQ ID NO: 248 - DNA, 120 bp, Artificial Sequence
  CsPRORP3 gene fragment
  CDS (1)..(120)
  misc_feature (1)..(45): deleted part of CsPRORP3 gene
atggattccactggctctgccaaagcaaggaagaaatccaagaaccaatcccctgaagtcaagttccagttagacctcactgactgttcgaggaggaaagatttactttcggccataact

SEQ ID NO: 249 - protein, 40 aa, Artificial Sequence
  Synthetic Construct
MDSTGSAKARKKSKNQSPEVKFQLDLTDCSRRKDLLSAIT

SEQ ID NO: 250 - DNA, 1637 bp, Solanum lycopersicum
ccatggtaaccccagaaggtcaattccggtcaagcctagataattgctccaaaaccaaagatctttctactgccatctccttatacgaatccgctatttcagatgcctcaacaatccgcctttccagtaaccatttcaattcttttctttacatctgctccaactctttttcagacccatcaacgaaaaatgacgctattcaatttgggtttcgagtttttgaacatatggattcgtgtaacataacccctaatgaggcaactgtcacggctgttgctcggctggcggcagcaactgatgacggtgacagagcatttgagttggctaaaggggtggggaattgtggaaagttaaggacttatggaccggctttgttttgtttttgtaagatgggtgaggctgataaggcctatcaagtggaagaacacatgcggtctcttggtttgcaacttgaggaagctgagcttgctgggttgttaaaggtgagtgtggagaaagaaagggaagagaaggtctatcagtatttacataaactgagaatgtcaatcaggagcgtaagtgactcgacagcagaaataatacagagttggtttggaggggaaatggcaactaaggtggggttatccaacggggatatggatcaggtgaaagaagtaattttacaaaatggtggagggtggcatggtctcggatggcttggaaagggtaaatggcttgcacagaggtcccaaatagctcctgatgggaggtgtctatcttgtggcgaacagttggtttgtgttgatattgacagatcagaaacggaacgatttgcagagtcagttgcttctttggcaatggaaagggaagtccattccaattttaaggaatttcaggactggctggaaaagcattcagattatgatgctgtagtagatgcagcaaatgttgggctttttcagcagaattttgctgcgggaggctttagtattgcacagtttgttgctgttgtgaaggaattgcatagcaggagcaacaagtggccactggtcatattacacaaaaagcgtgttcgtacacttcttgaggatgctggctatagagagttgcttgaagagtggataaatgaaaagatactttacggaacaccctttggatccaatgatgactggtactggctttatgcagcagtgaaatgtaagtgtttgctcgtgacaaatgatgaaatgagagatcacatctttgagctcctgggtagtagcttttttgcccgatggaaagaaagacatcaggtgaagtacacttttgttaaaggggagattaagcttctgatgccacccacatattctgttgtcattcaggaatccgagaacgggtcgtggcatgtgcctctggcaggtgaggtagttgaggagtcttcaaggacttggctctgcatcaccagacaggcttcatgtgaatctgacaataaacaacttgcaagtgtagtagaagcttctgaagttagtgaacctgatcaaattgcagcctgttgccattcagatagttttacaagtcagaatggcggcagcttaaataaatgttctggtttggctggtaagaggaaagagaggtccccttctccaactccatctcactccagtttacaatctctcgag

SEQ ID NO: 251 - DNA, 29 bp, Artificial Sequence
  Primer
taaccatggtaaccccagaaggtcaattc

SEQ ID NO: 252 - DNA, 32 bp, Artificial Sequence
  Primer
taactcgagagattgtaaactggagtgagatg

SEQ ID NO: 253 - DNA, 120 bp, Artificial Sequence
  SlPRORP3 gene fragment
  CDS (1)..(120)
  misc_feature (1)..(31): deleted part of SlPRORP3 gene
  sig_peptide (7)..(27): NLS
atggacaaagccaaaaacaagaagaaaaacctaaccccagaaggtcaattccggtcaagcctagataattgctccaaaaccaaagatctttctactgccatctccttatacgaatccgct

SEQ ID NO: 254 - protein, 40 aa, Artificial Sequence
  Synthetic Construct
MDKAKNKKKNLTPEGQFRSSLDNCSKTKDLSTAISLYESA

SEQ ID NO: 255 - DNA, 1478 bp, Lactica sativa
ccatggaatccccaacaccggaatccaaattccgctctgatttcagcatttgctccaaagagaaagatttggctggcgcaatctcccttttcgattccgcagtttctcaaaacctcaaactcaatctccaccacttgaattgcttcctttatatatgttccaactccatcgaagacaataaagacgttgcaatcgataaaggtttcagcattttcaatcacatgatatcgagcaagataaaccccaatgaagccactatcacagccgtttctaggttagccgcagcaaaagacgacgctgatttgtcatttgagttggttaaaagtttgctcaagtacaatgacaagcctcggttgcgaacctatgatccagcattattctgttacgtgaagaaatcagatgccgaaaaggcgtatttggtggagaaagacattttgagtatggggttgtgcttggaagaaccagagatcgctgcattgctgaaagtcagtgctgagacaggaaacgaagagaaggtgtatgaatatttgcataagttaagaattggcgtcaaatgtgtgaatgaatcaacagcagagatcattaccaattggttcaaaggagaaacgggggcgaaagtggccagtcgtttgaaagactgtgatatgggtcgggttaaagatatggttttgaagaatggaggtgggtggcatgggcttgggtggataacgaaaggaaaatgggtgttacagagaacaaccattgattcaaatggtgtttgttgtgcttgtaaagatcagttggcttgtgtcgatatcggtagagaagaaacagagaagtttgcacagtcgttaatggcgttggccattgaaagggagacccgatcaaatttcactcagtttcagaattggctggatgaacataatgattttgaagctatagttgatggagcaaatattggactttaccaacaaaactttgcagaaggtggatttagtgtttctcaggttgaaattgttgttaaagaactgtataacagaagcaagaaatggccacttgttattctacatgacaagagaattcgtgcccttttagctaatccttcaaatcgagagctacttgaagagtggattgaaagaggagttctttatggaacaccagttggatcaaatgatgactggtattggctttatgcttctgtaaaactcaagtgtatgcttgtgacaaatgatgaaatgagagaccatatttttgaacttttaggaggcaatttctttcccaggtggaaagaaagacatcaggttcattacactttcccaaaaggtaaacttcaacttcaaatgccaccaccatattccattcttattcaggaatctgagagaggaacatggcatgtgcccttagtgagtgatcacaatgatgagtcattaagaacatggctttgcatttcccattcagacctctgtaaaacttgttctgaagaaacttccagtctcgag

SEQ ID NO: 256 - DNA, 27 bp, Artificial Sequence
  Primer
taaccatggaatccccaacaccggaat

SEQ ID NO: 257 - DNA, 32 bp, Artificial Sequence
  Primer
taactcgagactggaagtttcttcagaacaag

SEQ ID NO: 258 - DNA, 120 bp, Artificial Sequence
  5' LsPRORP3 gene fragment
  CDS (1)..(120)
  misc_feature (1)..(34): 5' deleted part of LsPRORP3 gene
  sig_peptide (4)..(21): NLS
atgaagaatcagaggaaaaagataggtaacaacaaatccccaacaccggaatccaaattccgctctgatttcagcatttgctccaaagagaaagatttggctggcgcaatctcccttttc

SEQ ID NO: 259 - protein, 40 aa, Artificial Sequence
  Synthetic Construct
MKNQRKKIGNNKSPTPESKFRSDFSICSKEKDLAGAISLF

SEQ ID NO: 260 - DNA, 108 bp, Artificial Sequence
  3' LsPRORP3 gene fragment
  CDS (1)..(108)
  misc_feature (1)..(60): 3' deleted part of LsPRORP3 gene
  sig_peptide (22)..(36): NLS
acatggctttgcatttcccattcagacctctgtaaaacttgttctgaagaaacttccagttcacatgttggtataactggtaaaagaaaagaaagatcttcatcttag

SEQ ID NO: 261 - protein, 35 aa, Artificial Sequence
  Synthetic Construct
TWLCISHSDLCKTCSEETSSSHVGITGKRKERSSS

SEQ ID NO: 262 - DNA, 1445 bp, Allium cepa
ccatggcgaaaaaacaaaagccagaagctcagtttcgctataatctcgacacatgcataaagaacaacgatctcgatggcgctctcgctctctacaactccgctgcagttaatcttacttcttatcactacaacgctctcctccacttgctgtcttcttcatcccaatccaaggttatcgattacagtttcgaaatcttcaacaagatgatttcaagcggtataaaacctaatgaggcgacggtcacgaatgtggcgaggatagcggcaactaagtcaggtgaatacgcatttgatttcattaaaagaatgaaaagcgagtacaatgttacattgaagttgagaacttttgcaccggttatcaatgctttctgtaacgattttgaagcagagaaggcttatgaggttgagcattttatggctgatttgggtatttctccagaagaggtagaagttacggctttgctgagagtgagtagtaaaaaaggattaggagagaaagcatacgagtatttactgaagctgagaaattgtgtgaatagtgtgaaaccggaaacagtggagattctggaagagtggtttaaaagcgacaaggcatgtgaggtttgttgtgaaaattgggacgcggataaggttaaagaagtaatggtgatgcatggaggagggtggcatggaaccgggtggctggggaaagggaaatgggaagtaaagaaagggaatgtgagttcaaatggagaatgcagttgttgcaggaagaggctagcatgtgttgatgtggaggtgaaagaggtggagaattttgcagagtcagttgctagcttggctatggaaagagaaagacactctaatttcaagaatttccaggaatggttgaataaccatgctgattatgaagcaatagtagacggagcaaatgttgcattgtataaacaaaattttgcagaaggtggattcaatttgtctcagctagatactgttgtaagagagctcaatgcaatgcgaggaacatggccgcttgttatacttcataataagcgatatcggatgctcatggaagacccttccaataggcagctgcttgaaacctggaaagctaaaggagtgttgttcaccactccaaatggatctaatgatgattggtactggctctatgcagcagttcagctgaagtgcttactagtgacgaatgatgaaatgagggatcatatatttgagatccttggcaggagctttttccccaaatggaaagagcggcatcaggttaggtatacatttgtcaaaggcaaactgacgttagcaatgccacctccatattccgtagtaattcaggaatctgcattgggatcttggcacatacccattgatgacaaaagcaatgaagaaaacacgcgaacatggctttgtgtaactagatcagaatcatttggaaactgcgaagctctcgag

SEQ ID NO: 263 - DNA, 33 bp, Artificial Sequence
  Primer
taaccatggcgaaaaaacaaaagccagaagctc

SEQ ID NO: 264 - DNA, 29 bp, Artificial Sequence
  Primer
taactcgagagcttcgcagtttccaaatg

SEQ ID NO: 265 - DNA, 207 bp, Artificial Sequence
  AcPRORP3 gene fragment
  CDS (1)..(207)
  misc_feature (1)..(54): deleted part of AcPRORP3 gene
  sig_peptide (157)..(174): NLS
acgcgaacatggctttgtgtaactagatcagaatcatttggaaactgcgaagctaatgcaaatggaaaattggaaatttcagcagaagaattgcatactgtagacaaatcttcttcatttgataatatgaattctaatgatggatatattacatcaaggaaaaggaaagaaaggtctccatccccctcaaaggcagttgctagctag

SEQ ID NO: 266 - protein, 68 aa, Artificial Sequence
  Synthetic Construct
TRTWLCVTRSESFGNCEANANGKLEISAEELHTVDKSSSFDNMNSNDGYITSRKRKERSPSPSKAVAS

SEQ ID NO: 267 - DNA, 22 bp, Artificial Sequence
  Primer
gtcattcatatccccagcaatg

SEQ ID NO: 268 - DNA, 22 bp, Artificial Sequence
  Primer
ccctcggagtcgatcaatttat

SEQ ID NO: 269 - DNA, 25 bp, Artificial Sequence
  Primer
ctacagatacttctggaatggattc

SEQ ID NO: 270 - DNA, 19 bp, Artificial Sequence
  Primer
ggactcggccacatagcta

SEQ ID NO: 271 - DNA, 24 bp, Artificial Sequence
  Primer
gcaaggagaacttactcaacaatg

SEQ ID NO: 272 - DNA, 24 bp, Artificial Sequence
  Primer
tgtgacaaaaaacccaagtttcta

SEQ ID NO: 273 - DNA, 20 bp, Artificial Sequence
  Primer
gccattactaccggaaaatg

SEQ ID NO: 274 - DNA, 23 bp, Artificial Sequence
  Primer
gttctggaaaaggtatcaccttc

SEQ ID NO: 275 - DNA, 23 bp, Artificial Sequence
  Primer
ctcagtcgacccagaaaagtatg

SEQ ID NO: 276 - DNA, 26 bp, Artificial Sequence
  Primer
caaaactaacgaccacaaaaatgcta

The invention claimed is:

1. A method for increasing the resistance of a plant to a plant RNA virus, said plant RNA virus comprising an aminoacylatable 3' tRNA-like structure, wherein said method comprises expressing in said plant a mutant land plant protein-only RNase P (PRORP) enzyme (hereinafter called CytoRP), and wherein said CytoRP consists of an amino acid sequence selected from the group consisting of SEQ ID NO 121 to 230.

2. The method of claim 1, wherein said CytoRP is a mutant of an endogenous protein-only RNase P enzyme from said plant to which the method is applied.

3. The method of claim 1, wherein said CytoRP is able to cleave the aminoacylatable 3' tRNA-like structure of a plant RNA virus belonging to a genus selected from the group consisting of Tymovirus, Furovirus, Pomovirus, Pecluvirus, Tobamovirus, Bromovirus, Cucumovirus, and Hordeivirus.

4. The method of claim 1, wherein said plant to which the method is applied is selected from the group consisting of rice, corn, wheat, tomato, turnip, papaya, rapeseed, potato, tobacco, millet, sorghum, barley, manioc, cocoa, cucumber, vine, soybean, peach, apple, strawberry, clementine, orange, poplar, eucalyptus, ricinus, alfalfa (lucerne), lotus, carrot, pepper, aubergine, zucchini, melon, bean, spinach, lettuce, onion, celery, beet, squash, and strawberry.

5. An isolated polynucleotide encoding a CytoRP as defined in claim 1.

6. A recombinant expression cassette, wherein said recombinant expression cassette comprises the polynucleotide of claim 5, under control of a promoter functional in a plant cell.

7. A recombinant vector, wherein said recombinant vector contains an expression cassette comprising the polynucleotide of claim 5, under control of a promoter.

8. A host cell, wherein said host cell contains a recombinant expression cassette that comprises the polynucleotide of claim 5 under control of a promoter functional in a plant cell or said host cell contains a recombinant vector with an expression cassette comprising the polynucleotide of claim 5 under control of a promoter.

9. The host cell of claim 8, wherein said host cell is a plant cell.

10. A method for producing a transgenic plant having an increased resistance to a plant RNA virus, wherein said method comprises:
providing a plant cell, wherein said plant cell contains a recombinant expression cassette comprising a polynucleotide encoding a CytoRP as defined in claim 1 under control of a promoter functional in a plant cell or said plant cell contains a recombinant vector with an expression cassette comprising the polynucleotide encoding the CytoRP as defined in claim 1 under control of a promoter;
regenerating from said plant cell a transgenic plant expressing the CytoRP as defined in claim 1.

11. A transgenic plant obtainable by the method of claim 10, said transgenic plant containing a recombinant expression cassette that comprises a polynucleotide encoding a CytoRP under control of a promoter functional in the plant cell, wherein said CytoRP consists of an amino acid sequence selected from the group consisting of SEQ ID NO 121 to 230.

12. A transgenic plant r an isolated organ or tissue thereof, wherein it comprises, stably integrated in its genome, a recombinant expression cassette comprising a polynucleotide encoding a CytoRP as defined in claim 1.

13. A method of using the polynucleotide of claim 5 for producing a transgenic plant having an increased resistance to a plant RNA virus.

* * * * *

UNITED STATES PATENT AND TRADEMARK OFFICE
CERTIFICATE OF CORRECTION

| | |
|---|---|
| PATENT NO. | : 10,781,457 B2 |
| APPLICATION NO. | : 15/313058 |
| DATED | : September 22, 2020 |
| INVENTOR(S) | : P Giege et al. |

It is certified that error appears in the above-identified patent and that said Letters Patent is hereby corrected as shown below:

In the Claims

| Column | Line | |
|---|---|---|
| 20 | 57 | change "plant r an" to -- plant or an -- |

Signed and Sealed this
Nineteenth Day of December, 2023

Katherine Kelly Vidal
*Director of the United States Patent and Trademark Office*